US010781426B2

(12) United States Patent
Haagmans et al.

(10) Patent No.: US 10,781,426 B2
(45) Date of Patent: Sep. 22, 2020

(54) HUMAN BETACORONAVIRUS LINEAGE C AND IDENTIFICATION OF N-TERMINAL DIPEPTIDYL PEPTIDASE AS ITS VIRUS RECEPTOR

(71) Applicants: Erasmus University Medical Center Rotterdam, Rotterdam (NL); Dr. Soliman Fakeeh Hospital, Al Hamra District, Jeddah (SA)

(72) Inventors: Bartholomeus Leonardus Haagmans, Rotterdam (NL); Theodorus Marinus Bestebroer, Rotterdam (NL); Sander van Boheemen, Rotterdam (NL); Ronaldus Adrianus Maria Fouchier, Rotterdam (NL); Albertus Dominicus Marcellinus Erasmus Osterhaus, Rotterdam (NL); Ali Moh Zaki, Rotterdam (NL); Victor Stalin Raj, Rotterdam (NL); Berend Jan Bosch, Rotterdam (NL)

(73) Assignees: Erasmus University Medical Center Rotterdam, Rotterdam (NL); Dr. Soliman Fakeeh Hospital, Jeddah (SA)

( * ) Notice: Subject to any disclaimer, the term of this patent is extended or adjusted under 35 U.S.C. 154(b) by 0 days.

(21) Appl. No.: 14/430,010

(22) PCT Filed: Sep. 23, 2013

(86) PCT No.: PCT/IB2013/058772
§ 371 (c)(1),
(2) Date: Mar. 20, 2015

(87) PCT Pub. No.: WO2014/045254
PCT Pub. Date: Mar. 27, 2014

(65) Prior Publication Data
US 2015/0275183 A1    Oct. 1, 2015

Related U.S. Application Data

(60) Provisional application No. 61/704,531, filed on Sep. 23, 2012, provisional application No. 61/730,027, filed on Nov. 26, 2012, provisional application No. 61/831,070, filed on Jun. 4, 2013.

(51) Int. Cl.
C12N 7/00       (2006.01)
C12Q 1/70       (2006.01)
C07K 14/005     (2006.01)
A61K 35/76      (2015.01)
C07K 16/10      (2006.01)
C12N 9/48       (2006.01)
G01N 33/569     (2006.01)
G01N 33/573     (2006.01)
C07K 14/705     (2006.01)

(52) U.S. Cl.
CPC ............... *C12N 7/00* (2013.01); *A61K 35/76* (2013.01); *C07K 14/005* (2013.01); *C07K 16/10* (2013.01); *C12N 9/485* (2013.01); *C12Q 1/701* (2013.01); *G01N 33/56983* (2013.01); *G01N 33/573* (2013.01); *C07K 14/70596* (2013.01); *C07K 2319/30* (2013.01); *C12N 2770/20021* (2013.01); *C12N 2770/20022* (2013.01); *C12N 2770/20032* (2013.01); *C12N 2770/20034* (2013.01); *C12Q 2600/158* (2013.01); *C12Y 304/14005* (2013.01); *G01N 2333/165* (2013.01); *G01N 2333/948* (2013.01); *G01N 2500/02* (2013.01)

(58) Field of Classification Search
CPC .............................. A61K 35/76; A61K 39/215
See application file for complete search history.

(56) References Cited

FOREIGN PATENT DOCUMENTS

WO    2013/164476    11/2013

OTHER PUBLICATIONS

Woo et al. Journal of Virology 2007, vol. 81 (4) pp. 1574-1585.*
Lau et al. Journal of Virology, 2013, vol. 87 (15), pp. 8636-8650.*
Golda et al. Current Opinion in Pulmonary Medicine, 2008, vol. 14, pp. 248-253.*
BigDye Terminator v3.1 sequencing standard Kit , 3500 Series Genetic Analyzers published by AB Applied Biosystems 2009, pp. 1-2.*
Nucleic Acid Isolation and Purification, published by Roche Diagnostic, 2011, pp. 1-260.*
van Boheemen et al. mBio, 2012, published on line on Nov. 2012, pp. 1-9.*

(Continued)

Primary Examiner — Bao Q Li
(74) Attorney, Agent, or Firm — BakerHostetler

(57) ABSTRACT

The invention provides an isolated essentially mammalian positive-sense single stranded RNA virus classifiable as belonging to the Order: Nidovirales; Family: Coronaviridae; Subfamily: Coronavirinae; Genus: *Betacoronavirus*; and non-Lineage A, non-Lineage B or non-Lineage D, human *betacoronavirus*. The invention also provides a human virus having a receptor binding domain (RBD) capable of binding to a dipeptidyl peptidase 4. The invention also provides diagnostic means and methods, prophylactic means and methods and therapeutic means and methods to be employed in the diagnosis, prevention and/or treatment of disease, in particular of respiratory disease, in particular of mammals, more in particular in humans.

Figure 1:
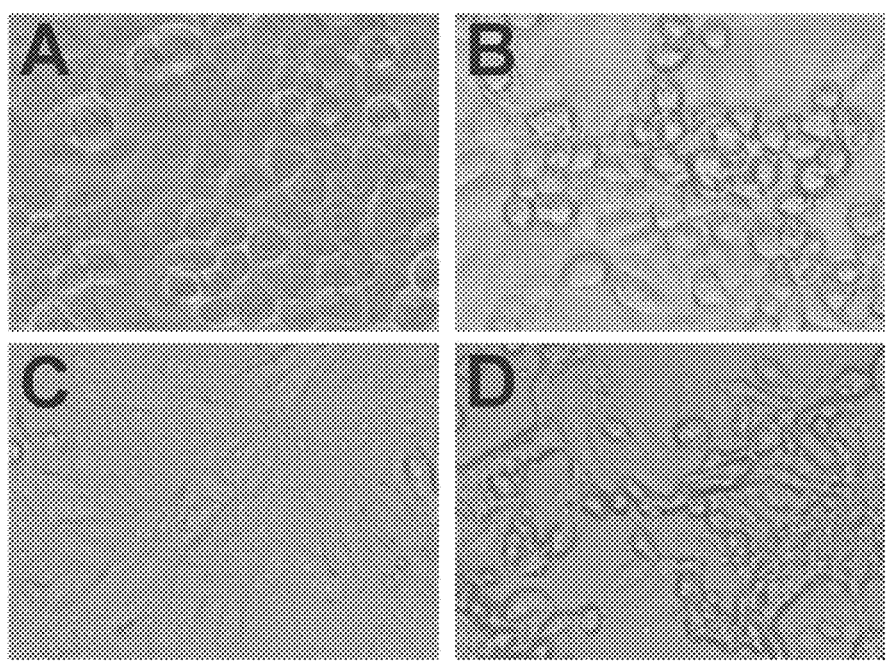

6 Claims, 128 Drawing Sheets
Specification includes a Sequence Listing.

(56) References Cited

OTHER PUBLICATIONS

International Search Report and Written Opinion PCT/IB2013/058772 dated Nov. 14, 2014 (19 pages).
Zaki. Novel Coronavirus—Saudi Arabia: Human Isolate. A ProMED-mail post. International Society for Infectious Diseases. Sep. 15, 2012, 2 pages.
EMBL-EBI. JX869059 CP-002727344 Human betacoronavirus 2c EMC/2012 complete genome (2014) pp. 1-15.
van Boheemen et al. Genomic Characterization of a Newly Discovered Coronavirus Associated with Acute Respiratory Distress Syndrome in Humans. MBIO 3 (2012) e00473-12, pp. 1-9.
Zhao et al. A safe and convenient pseudovirus-based inhibition assay to detect neutralizing antibodies and screen for viral entry inhibitors against the novel human coronavirus MERS-CoV. Virology Journal 10 (2013) 1-8.
Wrenger et al. The N-terminal structure of HIV-1 Tat Is Required for Suppression of CD26-dependent T Cell Growth.* The Journal of Biological Chemistry 272 (1997) 30283-30288.
Cockrell et al. Mouse Dipeptidyl Peptidase 4 Is Not a Functional Receptor for Middle East Respiratory Syndrome Coronavirus Infection. J. Virology 88 (2014) 5195-5199.
Erasmus MC, "No restrictions for public health research into MERS coronavirus", Erasmus MC Press Release, Rotterdam, May 24, 2013, 1 page.
Lau et al., "Genetic Characterization of *Betacoronavirus* Lineage C Viruses in Bats Reveals Marked Sequence Divergence in the Spike Protein of *Pipistrellus* Bat Coronavirus HKU5 in Japanese Pipistrelle: Implications for the Origin of the Novel Middle East Respiratory Syndrome Coronavirus", Journal of Virology, 87(15), 8638-8650.
Madoff, L., "Detecting Emerging Infectious Disease Threats Using the Internet: The First 20 Years", ProMED, 2012, 37 pages.
UK National Archives, "Acute respiratory illness associated with a new virus identified in the UK", Sep. 23, 2012, 2 pages.
Woo et al., "Compariative Analysis of Twelve Genomes of Three Novel Group 2c and Group 2d Coronaviruses Reveals Unique Group and Subgroup Features", Journal of Virology, 2006, 81(4), 1574-1585.
Zaki et al., "Isolation of a Novel Coronavirus from a Man with Pneumonia in Saudi Arabia", The New England Journal of Medicine, 2012, 367:1814-1820.

* cited by examiner

```
              10        20        30        40        50        60        70        80
              ....|....|....|....|....|....|....|....|....|....|....|....|....|....|....|....|
HCoV-SA1      GGGGTTGGGACTATCCTAAGTGTGATAGAGCTAAGCCTAATATGTGTAGATCTTCGCTTCACTCCAATTAGTCGTAAA 90       100       110       120       130       140       150       160
              ....|....|....|....|....|....|....|....|....|....|....|....|....|....|....|....|
HCoV-SA1      CATGGCACTTGTTGGTACTACAAGGGACAAGATTTTATCGCTTGGCAAATGAGTGCTAGGGCTAAGCGAAATGTTCT 170       180       190       200       210       220       230       240
              ....|....|....|....|....|....|....|....|....|....|....|....|....|....|....|....|
HCoV-SA1      ATGTGGTGGTGGTTACTACTGCTTAAACCTGGAGGTACCAGTAGCGGAGATGCCACCACTGCATATGCCAATAGTGTCTTTA 250       260       270       280       290       300       310       320
              ....|....|....|....|....|....|....|....|....|....|....|....|....|....|....|....|
HCoV-SA1      ACATTTTGCAGGCGACAACTGCTAATGTCAGTGCTACTTATGGGTGCTAAACAAGATTGTTGACAAGAAGTTAAA 330       340       350       360       370       380       390       400
              ....|....|....|....|....|....|....|....|....|....|....|....|....|....|....|....|
HCoV-SA1      GACATGCAGTTTGATTTGTATGTCAATGTTTACAGGAGCACTAGCCCCAGACCCCAAATTTGTTGAAAAATACTATGCTTTT 410       420       430       440       450
              ....|....|....|....|....|....|....|....|....|....|
HCoV-SA1      TCTTAATAAGCACTTTCTATGATGATGATACTGTCTGACGACGGCGTTGTGTGTAA

Fig. 3
```

Figure 12:
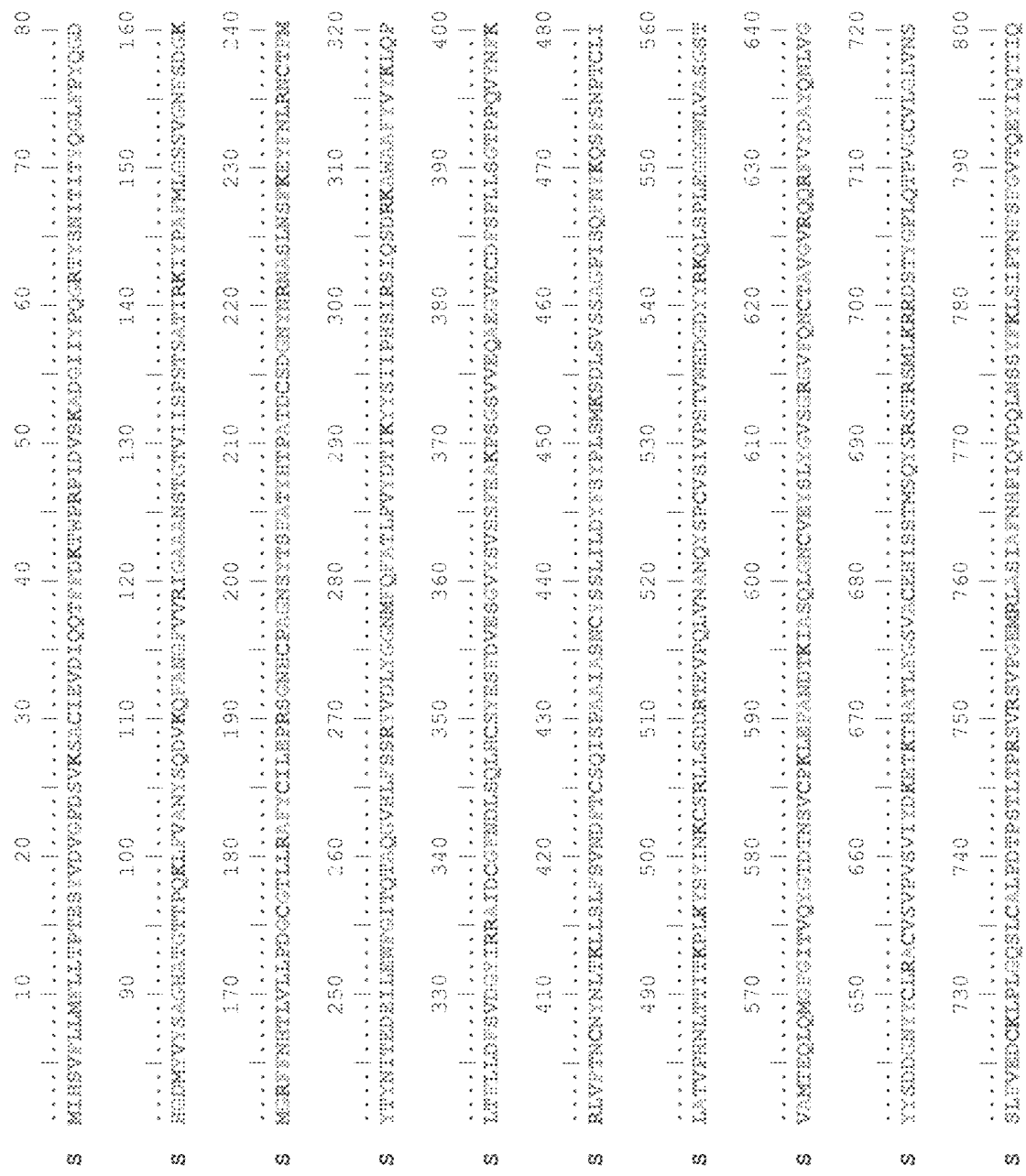

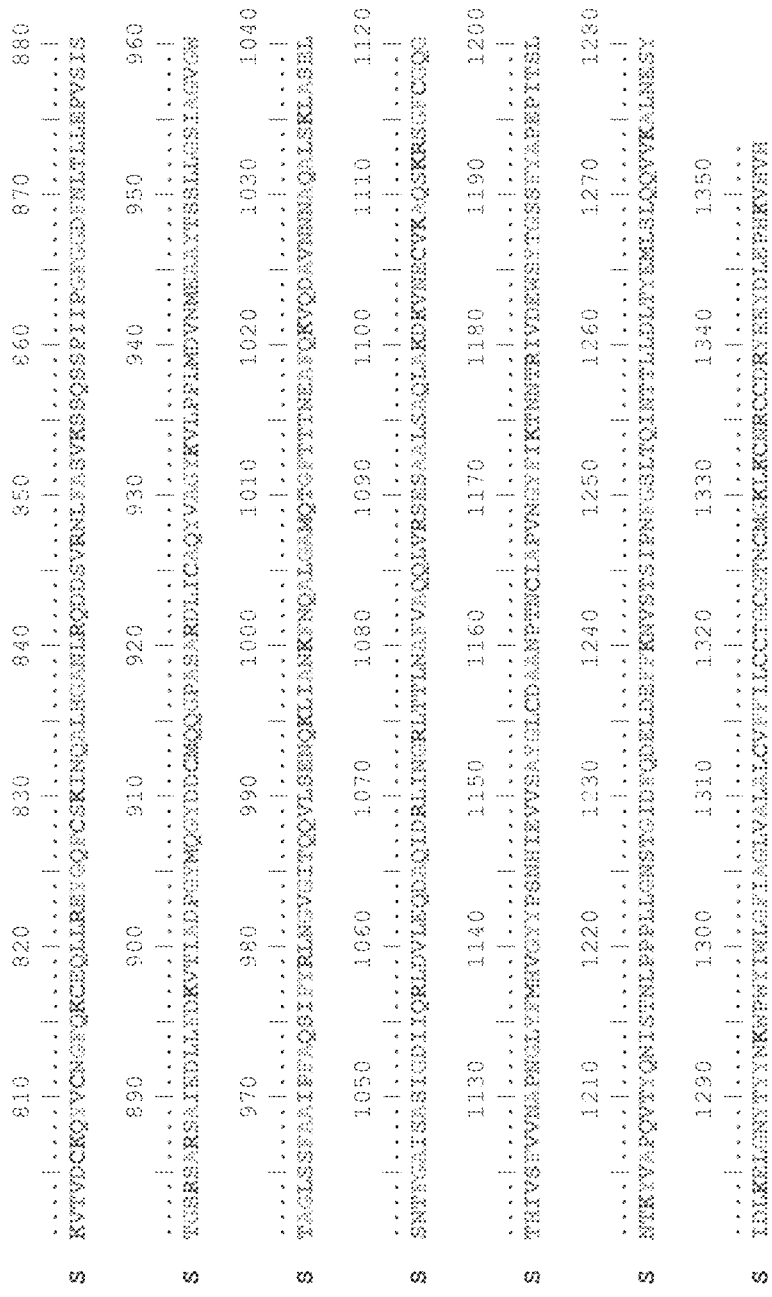
Fig. 12, Cont'd

Fig. 13

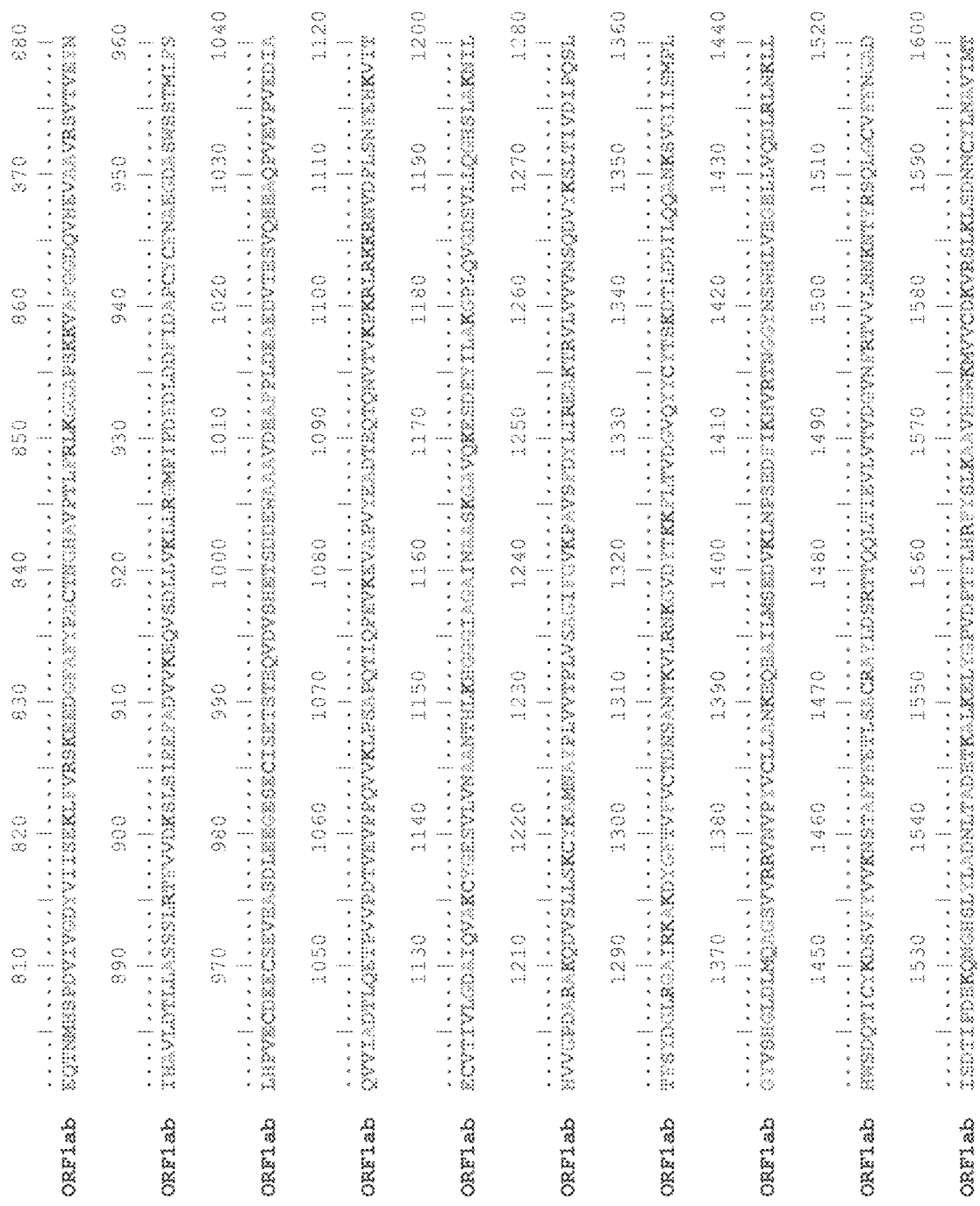
Fig. 13, Cont'd

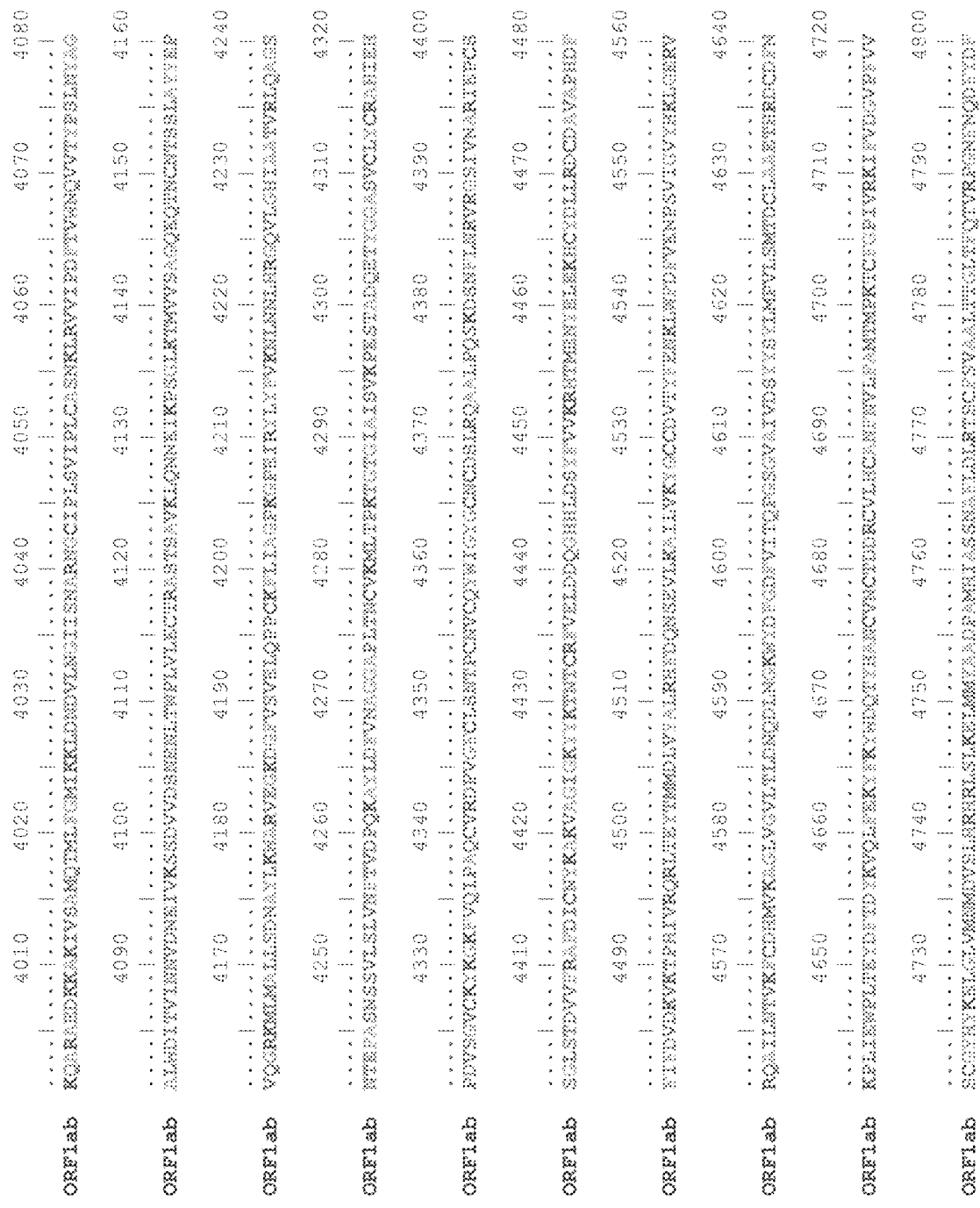

Fig. 13, Cont'd

Fig. 13, Cont'd

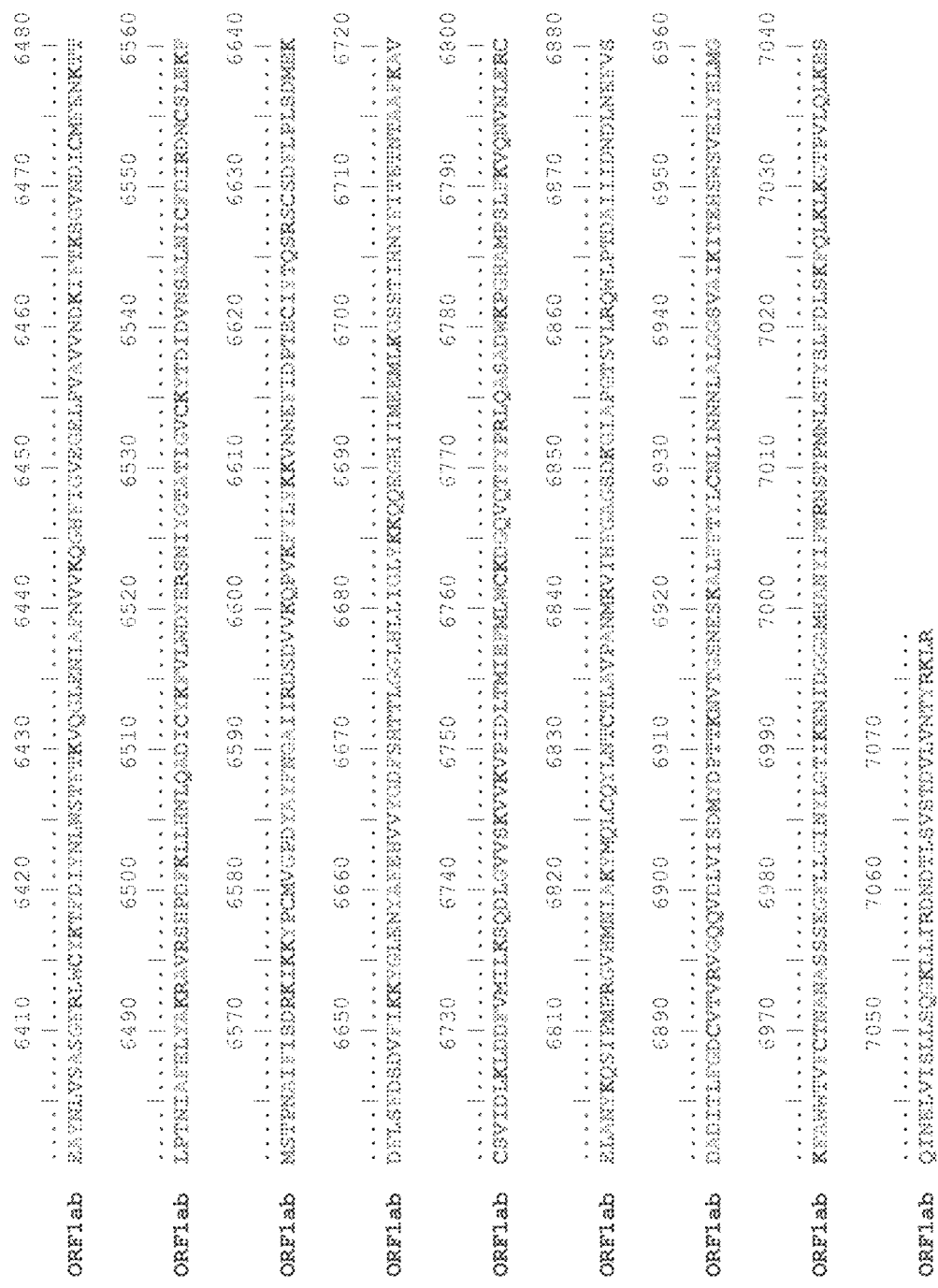
Fig. 13, Cont'd

Fig. 14

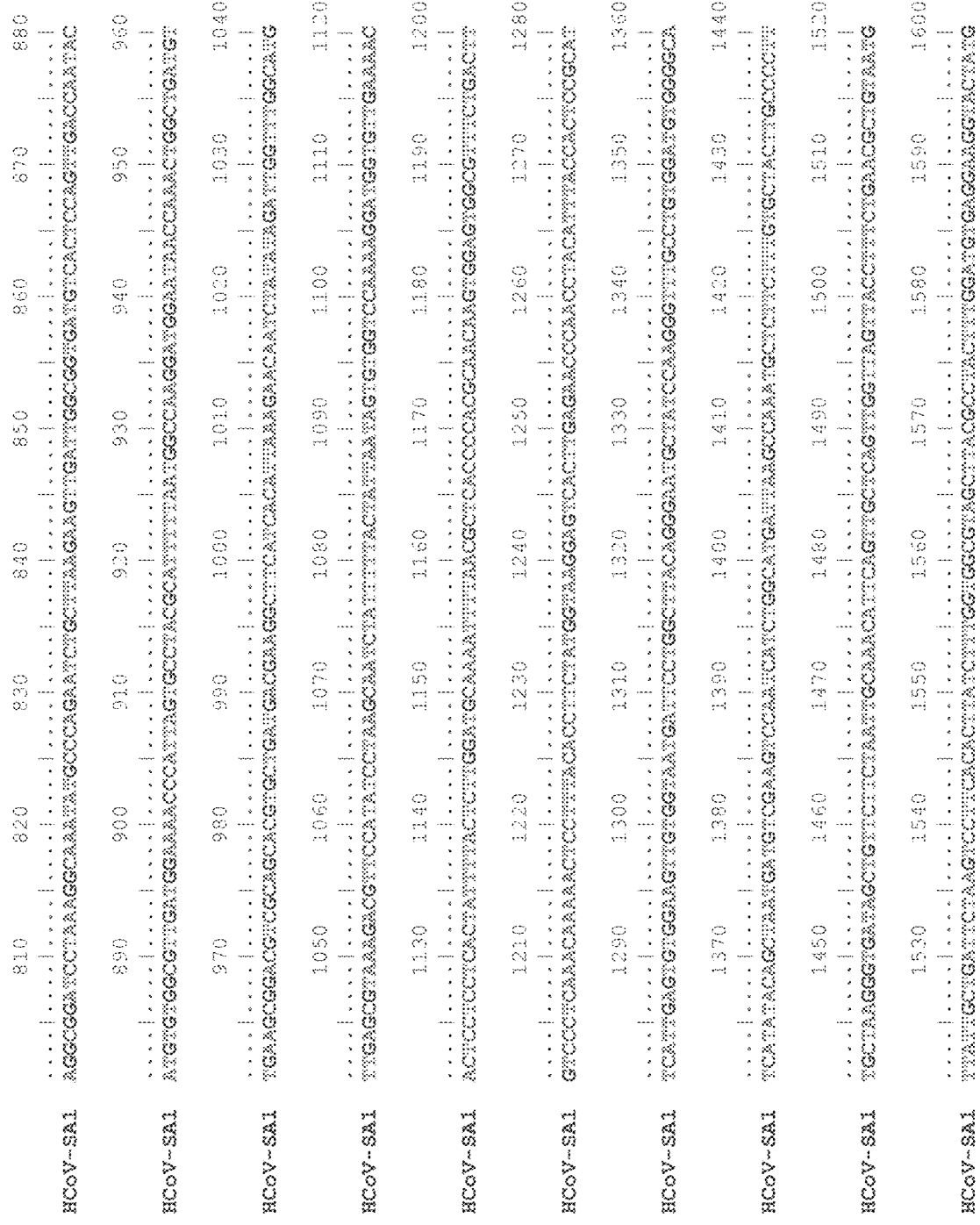
Fig. 14, Cont'd

```
              5610      5620      5630      5640      5650      5660      5670      5680
           ....|....|....|....|....|....|....|....|....|....|....|....|....|....|....|
HCoV-SA1   CTGGCACCGTTAGCAAGACTTCAGAGACTGGAAGTGCAAGGTGACAGATGTACTTCCCCGGCCAAAATACAGTAGCGAT 5690      5700      5710      5720      5730      5740      5750      5760
           ....|....|....|....|....|....|....|....|....|....|....|....|....|....|....|
HCoV-SA1   TGTAATGTCGTACGGTATTCTTTGGACGGTAATTCAGAACAGAGGTTGATCCGACCTAATCGCTTTCTATGTTAAGGA 5770      5780      5790      5800      5810      5820      5830      5840
           ....|....|....|....|....|....|....|....|....|....|....|....|....|....|....|
HCoV-SA1   TGGTAAATACTTTACAAGTGAACCACCCCGTAACATATTCACCAGCTACCAATTTTAGCTGGTAGTGTCTACACTTAATAGCT 5850      5860      5870      5880      5890      5900      5910      5920
           ....|....|....|....|....|....|....|....|....|....|....|....|....|....|....|
HCoV-SA1   GCCTTGATCGTATCTGATGGACAACCTGGCGGTGATGCTATTAGTTTGAGTTTAATAACCTTTAGGGTTTGATTCTAGT 5930      5940      5950      5960      5970      5980      5990      6000
           ....|....|....|....|....|....|....|....|....|....|....|....|....|....|....|
HCoV-SA1   AAACCAGTCACTAAGAAAATACACTTACTCCTTCTTGCCTAAGAAGACGGGCATGTGGTTGGCTGAGTTTGACACTTA 6010      6020      6030      6040      6050      6060      6070      6080
           ....|....|....|....|....|....|....|....|....|....|....|....|....|....|....|
HCoV-SA1   TGACCCTATTTATAAGAATGGTGCCATGTATAAAGGCAAACCAATTCTTTGGGTCAATAAAGCATCTTATGATACTAATC 6090      6100      6110      6120      6130      6140      6150      6160
           ....|....|....|....|....|....|....|....|....|....|....|....|....|....|....|
HCoV-SA1   TTAATAAGTTCAATAGAGCCTAGTTTGCGTCAAATTTTGACGTAGACCTCCAACTGTAGATGTGGTAGCACTGTAGATGTGGTAACTGAAATAATTTCACACCTTTG 6170      6180      6190      6200      6210      6220      6230      6240
           ....|....|....|....|....|....|....|....|....|....|....|....|....|....|....|
HCoV-SA1   AGTGTGGAGTCCTACACCAGTTGAACCTCCAACTGTAGATGTGGTAGCACTGTAGATGTGGTAACTGAAATAATTGTCAAATGTAA 6250      6260      6270      6280      6290      6300      6310      6320
           ....|....|....|....|....|....|....|....|....|....|....|....|....|....|....|
HCoV-SA1   GGGTTTAAATAAACCTTTCGTGAAGGACAATGTCAGTTTCGTTGCTGATGATTCAGGTAGCACTTACCCCGTTGTTGAGTATCTGT 6330      6340      6350      6360      6370      6380      6390      6400
           ....|....|....|....|....|....|....|....|....|....|....|....|....|....|....|
HCoV-SA1   CTAAAGAAGACCTACATACAATTGTATGTAGACCCTAAGTAATCAAGTCATTGTCGCTGATGATTCAGGAAGACAATGTACTTCTCTTCTATG
```

Fig. 14, Cont'd

```
                  7210      7220      7230      7240      7250      7260      7270      7280
              ....|....|....|....|....|....|....|....|....|....|....|....|....|....|....|....|
HCoV-SA1      GTTGTTGGCAGGTACATTGCATTATTTCTTTGCACAGACTTCCATATTTGTAGACTGGCGGTCATACAATTATGCTGTGT 7290      7300      7310      7320      7330      7340      7350      7360
              ....|....|....|....|....|....|....|....|....|....|....|....|....|....|....|....|
HCoV-SA1      CTAGTGCCTTCTGGTTATTCACCCACATTCCAATGGCGGGTTTGGTACGAATGTATAATTTGTTAGCATGCCTTTGGCTT 7370      7380      7390      7400      7410      7420      7430      7440
              ....|....|....|....|....|....|....|....|....|....|....|....|....|....|....|....|
HCoV-SA1      TTACGCAAGTTTTATCAGCATGTAATCAATGGTTGCAAAGATACGGCATGCTTGCTCTGCTATAAGAGGAACCGACTTAC 7450      7460      7470      7480      7490      7500      7510      7520
              ....|....|....|....|....|....|....|....|....|....|....|....|....|....|....|....|
HCoV-SA1      TAGAGTTGAAGCTTCTACCGTTGTCTGTGGTGGAAAACGTACGTTTTATATCACAGCAAATGGCGGTATTTCATTCTGTC 7530      7540      7550      7560      7570      7580      7590      7600
              ....|....|....|....|....|....|....|....|....|....|....|....|....|....|....|....|
HCoV-SA1      GTAGGCATAATTGGAATTGTGTGGATTGTGACACTGCAGGTGTGGGGAATACCTTCATCTGTGAAGAAGTCGCAAATGAC 7610      7620      7630      7640      7650      7660      7670      7680
              ....|....|....|....|....|....|....|....|....|....|....|....|....|....|....|....|
HCoV-SA1      CTCACTACCGCCCTACGCAGGCCTATTAACGCTACGGATAGATCACATTATTATGTGGATTCCGTTACAGTTAAAGAGAC 7690      7700      7710      7720      7730      7740      7750      7760
              ....|....|....|....|....|....|....|....|....|....|....|....|....|....|....|....|
HCoV-SA1      TGTTGTTCAGTTTAATTATCGTAGAGACGGTCAACCATTCTACGAGCGGTTTCCCCTCTGCGCTTTTACAAATCTAGATA 7770      7780      7790      7800      7810      7820      7830      7840
              ....|....|....|....|....|....|....|....|....|....|....|....|....|....|....|....|
HCoV-SA1      AGTTGAAGTTCAAAGAGGTCTGTAAAACTACTACTGGTATACCTGAATACAACTTTATCATCTACGACTCATCAGATCGT 7850      7860      7870      7880      7890      7900      7910      7920
              ....|....|....|....|....|....|....|....|....|....|....|....|....|....|....|....|
HCoV-SA1      GGCCAGGAAAGTTTAGCTAGGTCTGCATGTGTTTATTATTCTCAAGTCTTGTGTAAATCAATTCTTTTGGTTGACTCAAG 7930      7940      7950      7960      7970      7980      7990      8000
              ....|....|....|....|....|....|....|....|....|....|....|....|....|....|....|....|
HCoV-SA1      TTTGGTTACTTCTGTTGGTGATTCTAGTGAAATCGCCACTAAAATGTTTGATTCCTTTGTTAATAGTTTCGTCTCGCTGT
```

```
                 10410     10420     10430     10440     10450     10460     10470     10480
             ....|....|....|....|....|....|....|....|....|....|....|....|....|....|....|....|
HCoV-SA1     CATTCACTGTTGTAATGCGCCCTAACTACACAATTAAGGGTTCCTTTCTGTGTGGTTCTTGTGGTAGTGTTGGTTACACC 10490     10500     10510     10520     10530     10540     10550     10560
             ....|....|....|....|....|....|....|....|....|....|....|....|....|....|....|....|
HCoV-SA1     AAGGAGGGTAGTGTGATCAATTTCTGTTACATGCATCAAATGGAACTTGCTAATGGTACACATACCGGTTCAGCATTTGA 10570     10580     10590     10600     10610     10620     10630     10640
             ....|....|....|....|....|....|....|....|....|....|....|....|....|....|....|....|
HCoV-SA1     TGGTACTATGTATGGTGCCTTTATGGATAAACAAGTGCACCAAGTTCAGTTAACAGACAAATACTGCAGTGTTAATGTAG 10650     10660     10670     10680     10690     10700     10710     10720
             ....|....|....|....|....|....|....|....|....|....|....|....|....|....|....|....|
HCoV-SA1     TAGCTTGGCTTTACGCAGCAATACTTAATGGTTGCGCTTGGTTTGTAAAACCTAATCGCACTAGTGTTGTTTCTTTTAAT 10730     10740     10750     10760     10770     10780     10790     10800
             ....|....|....|....|....|....|....|....|....|....|....|....|....|....|....|....|
HCoV-SA1     GAATGGGCTCTTGCCAACCAATTCACTGAATTTGTTGGCACTCAATCCGTTGACATGTTAGCTGTCAAAACAGGCGTTGC 10810     10820     10830     10840     10850     10860     10870     10880
             ....|....|....|....|....|....|....|....|....|....|....|....|....|....|....|....|
HCoV-SA1     TATTGAACAGCTGCTTTATGCGATCCAACAACTGTATACTGGGTTCCAGGGAAAGCAAATCCTTGGCAGTACCATGTTGG 10890     10900     10910     10920     10930     10940     10950     10960
             ....|....|....|....|....|....|....|....|....|....|....|....|....|....|....|....|
HCoV-SA1     AAGATGAATTCACACCTGAGGATGTTAATATGCAGATTATGGGTGTGGTTATGCAGAGTGGTGTGAGAAAAGTTACATAT 10970     10980     10990     11000     11010     11020     11030     11040
             ....|....|....|....|....|....|....|....|....|....|....|....|....|....|....|....|
HCoV-SA1     GGTACTGCGCATTGGTTGTTTGCGACCCTTGTCTCAACCTATGTGATAATCTTACAAGCCACTAAATTTACTTTGTGGAA 11050     11060     11070     11080     11090     11100     11110     11120
             ....|....|....|....|....|....|....|....|....|....|....|....|....|....|....|....|
HCoV-SA1     CTACTTGTTTGAGACTATTCCCACACAGTTGTTCCCACTCTTATTTGTGACTATGGCCTTCGTTATGTTGTTGGTTAAAC 11130     11140     11150     11160     11170     11180     11190     11200
             ....|....|....|....|....|....|....|....|....|....|....|....|....|....|....|....|
HCoV-SA1     ACAAACACACCTTTTTGACACTTTTCTTGTTGCCTGTGGCTATTTGTTTGACTTATGCAAACATAGTCTACGAGCCCACT
```

Fig. 14, Cont'd

```
                11210     11220     11230     11240     11250     11260     11270     11280
        ....|....|....|....|....|....|....|....|....|....|....|....|....|....|....|....|
HCoV-SA1 ACTCCCATTTCGTCAGCGCTGATTGCAGTTGCAAATTGGCTTGCCCCCACTAATGCTTATATGCGCACTACACATACTGA 11290     11300     11310     11320     11330     11340     11350     11360
        ....|....|....|....|....|....|....|....|....|....|....|....|....|....|....|....|
HCoV-SA1 TATTGGTGTCTACATTAGTATGTCACTTGTATTAGTCATTGTAGTGAAGAGATTGTACAACCCATCACTTTCTAACTTTG 11370     11380     11390     11400     11410     11420     11430     11440
        ....|....|....|....|....|....|....|....|....|....|....|....|....|....|....|....|
HCoV-SA1 CGTTAGCATTGTGCAGTGGTGTAATGTGGTTGTACACTTATAGCATTGGAGAAGCCTCAAGCCCCATTGCCTATCTGGTT 11450     11460     11470     11480     11490     11500     11510     11520
        ....|....|....|....|....|....|....|....|....|....|....|....|....|....|....|....|
HCoV-SA1 TTTGTCACTACACTCACTAGTGATTATACGATTACAGTCTTTGTTACTGTCAACCTTGCAAAAGTTTGCACTTATGCCAT 11530     11540     11550     11560     11570     11580     11590     11600
        ....|....|....|....|....|....|....|....|....|....|....|....|....|....|....|....|
HCoV-SA1 CTTTGCTTACTCACCACAGCTTACACTTGTGTTTCCGGAAGTGAAGATGATACTTTTATTATACACATGTTTAGGTTTCA 11610     11620     11630     11640     11650     11660     11670     11680
        ....|....|....|....|....|....|....|....|....|....|....|....|....|....|....|....|
HCoV-SA1 TGTGTACTTGCTATTTTGGTGTCTTCTCTCTTTTGAACCTTAAGCTTAGAGCACCTATGGGTGTCTATGACTTTAAGGTC 11690     11700     11710     11720     11730     11740     11750     11760
        ....|....|....|....|....|....|....|....|....|....|....|....|....|....|....|....|
HCoV-SA1 TCAACACAAGAGTTCAGATTCATGACTGCTAACAATCTAACTGCACCTAGAAATTCTTGGGAGGCTATGGCTCTGAACTT 11770     11780     11790     11800     11810     11820     11830     11840
        ....|....|....|....|....|....|....|....|....|....|....|....|....|....|....|....|
HCoV-SA1 TAAGTTAATAGGTATTGGCGGTACACCTTGTATAAAGGTTGCTGCTATGCAGTCTAAACTTACAGATCTTAAATGCACAT 11850     11860     11870     11880     11890     11900     11910     11920
        ....|....|....|....|....|....|....|....|....|....|....|....|....|....|....|....|
HCoV-SA1 CTGTGGTTCTCCTCTCTGTGCTCCAACAGTTACACTTAGAGGCTAATAGTAGGGCCTGGGCTTTCTGTGTTAAATGCCAT 11930     11940     11950     11960     11970     11980     11990     12000
        ....|....|....|....|....|....|....|....|....|....|....|....|....|....|....|....|
HCoV-SA1 AATGATATATTGGCAGCAACAGACCCCAGTGAGGCTTTCGAGAAATTCGTAAGTCTCTTTGCTACTTTAATGACTTTTTC
```

```
             13610     13620     13630     13640     13650     13660     13670     13680
          ....|....|....|....|....|....|....|....|....|....|....|....|....|....|....|....|
HCoV-SA1  GGCATCATTAGACTCCTATTTTGTCGTTAAGAGGCATACTATGGAGAATTATGAACTAGAGAAGCACTGTTACGACTTTG 13690     13700     13710     13720     13730     13740     13750     13760
          ....|....|....|....|....|....|....|....|....|....|....|....|....|....|....|....|
HCoV-SA1  TTACGTGACTGTGATGCTGTAGCTCCCCATGATTTCTTCAATCTTTGATGTAGACAAAGTTAAACACCTCAATTGTACG 13770     13780     13790     13800     13810     13820     13830     13840
          ....|....|....|....|....|....|....|....|....|....|....|....|....|....|....|....|
HCoV-SA1  TCAGCGTTTAACTGAGTACAACTAAGGATGGATCTTGTAAAAGCCCTGAGGCACTTTGAACAAAATAGCGAAGTGCTTAAGG 13850     13860     13870     13880     13890     13900     13910     13920
          ....|....|....|....|....|....|....|....|....|....|....|....|....|....|....|....|
HCoV-SA1  CTATCCTTAGTGAAGTATTGGTTGCGCGTGATGTTACCTACTTTGAAAATAAACTTCGGTTTGATTTTGTTGAAAACCCAGT 13930     13940     13950     13960     13970     13980     13990     14000
          ....|....|....|....|....|....|....|....|....|....|....|....|....|....|....|....|
HCoV-SA1  GTTATTGGTGTGTTTACATAAAACTTGGAGAACGGTACGCCAAGCTAACTTAAAACACTTGGTTTAAATTTGTGACCACAAGGGT 14010     14020     14030     14040     14050     14060     14070     14080
          ....|....|....|....|....|....|....|....|....|....|....|....|....|....|....|....|
HCoV-SA1  CAAGGCTGGTTAGTCGGTGTGCTCACACTAGACCACCAGGACCCTTAAAGGCAAGTGGTATGATTTTGGTGACTTCGTAA 14090     14100     14110     14120     14130     14140     14150     14160
          ....|....|....|....|....|....|....|....|....|....|....|....|....|....|....|....|
HCoV-SA1  TCACTCAACTCGGTTCAGGAGTAGGGAATTGTGATTTGATAGCTACTAGTTCTTATTCGATTGAAGCCTGTGCTCCAAATGACCGATTGT 14170     14180     14190     14200     14210     14220     14230     14240
          ....|....|....|....|....|....|....|....|....|....|....|....|....|....|....|....|
HCoV-SA1  CTGGCCGCTGAGACACATAGGGATTGTGATTTTAATAAACCACTCCATTGAGTGGCCACTTACTGAGTATGAATTTACTGA 14250     14260     14270     14280     14290     14300     14310     14320
          ....|....|....|....|....|....|....|....|....|....|....|....|....|....|....|....|
HCoV-SA1  TTATAAGGTACAACTCTTTGAGAAGTACTACTTTTAAATATTGGGATCCAGACGTATCAGCAAATTGCGTTAATTGTACTGAATG 14330     14340     14350     14360     14370     14380     14390     14400
          ....|....|....|....|....|....|....|....|....|....|....|....|....|....|....|....|
HCoV-SA1  ACCGTTGCTGTGTGTTACATTGCTAATTCAATTTCAAGTGATTGTTGCTAATGACCAAGCCTAAGACTTGTTCGGACCCATAGTC
```

```
HCoV-SA1    ATTTCGAGCGCAATTGATTATAGTGAGTGGTAT

Fig. 14, Cont'd

Fig. 14, Cont'd

```
                  19210     19220     19230     19240     19250     19260     19270     19280
                  ....|....|....|....|....|....|....|....|....|....|....|....|....|....|....|....|
HCoV-SA1   GTGCATCTGAGTTCAATTGCCAAGGTTGTGAATGGCGGTAGTTTGTAAGTTA

Fig. 14, Cont'd

```
HCoV-SA1      20810     20820     20830     20840     20850     20860     20870     20880
         ....|....|....|....|....|....|....|....|....|....|....|....|....|....|....|....|
         TTATACATTTGGCGCTGGTTCTGATAAGGTATCGCTTGGTACCTCAGTTACGACAGTGGCTTCCTACAGATGCC

HCoV-SA1      20890     20900     20910     20920     20930     20940     20950     20960
         ....|....|....|....|....|....|....|....|....|....|....|....|....|....|....|
         ATTATTAAAGAATAATGATTTAAAGAGTTCGTGTTCAGATGCTGACATAACTTTATTTGGAGATTGTGTAACTGTACGTGT

HCoV-SA1      20970     20980     20990     21000     21010     21020     21030     21040
         ....|....|....|....|....|....|....|....|....|....|....|....|....|....|....|
         CGGCCAACAAGTGGATCTTGTTATTTCCGACATGTATGATCCTACTAAGAATGTAACAGGTAGTATGAGTCAAAGG

HCoV-SA1      21050     21060     21070     21080     21090     21100     21110     21120
         ....|....|....|....|....|....|....|....|....|....|....|....|....|....|....|
         CTTTATTCTTTACTTGTACCTGTAACCTCATTAATAATAATCTTGCTCTTGGTGGGTCTGTTGCTATTAAATAACAGAA

HCoV-SA1      21130     21140     21150     21160     21170     21180     21190     21200
         ....|....|....|....|....|....|....|....|....|....|....|....|....|....|....|
         CACTCCTTGGAGCGTTTGAACTTTATGGGGAAATTTGCTTGGTGGGAACTGTTTTCGCACCAAGCAAATGCATC

HCoV-SA1      21210     21220     21230     21240     21250     21260     21270     21280
         ....|....|....|....|....|....|....|....|....|....|....|....|....|....|....|
         CTCATCTGAAGGATTCCTCTTAAGTTATTAATTACTGGGTACTATTAAGAAAATATAGATGGTGGTGCTATGCCACGCCA

HCoV-SA1      21290     21300     21310     21320     21330     21340     21350     21360
         ....|....|....|....|....|....|....|....|....|....|....|....|....|....|....|
         ACTATATAAATTGGAGAAATTCCACCCCATGAATCGAGTACTATTGAATTTACTCACTTTTGATTATCCAAGTTTCAATAAAA

HCoV-SA1      21370     21380     21390     21400     21410     21420     21430     21440
         ....|....|....|....|....|....|....|....|....|....|....|....|....|....|....|
         TTAAAGGAACACCAGTTCTTCAATTAAAGGAGAGTCAAATCGAACTCGTAATAACCTACTCCTCGTCGCAGGGTAAGTT

HCoV-SA1      21450     21460     21470     21480     21490     21500     21510     21520
         ....|....|....|....|....|....|....|....|....|....|....|....|....|....|....|
         ACTTATCCGGTGACAAAGAATACACCTCAGTTGTTCCACTCCACTGATGTTCTTGTTAACACCTTACAGAAAAGTTACGTTGATGTGTAGG

HCoV-SA1      21530     21540     21550     21560     21570     21580     21590     21600
         ....|....|....|....|....|....|....|....|....|....|....|....|....|....|....|
         CCAGATTCGTTAAGCTGGCTGGTTGTATTGAGGTTGATATACAACAGAGACTTTCTTGATAAAACTTGGCCTAGGCCAATTGA
```

Fig. 14, Cont'd

```
                 21610     21620     21630     21640     21650     21660     21670     21680
                    ....|....|....|....|....|....|....|....|....|....|....|....|....|....|....|....|
HCoV-SA1    TGCTTCTAAGGCTGACGGTATTATTATACCCTCAAGGCCGTACAATTCTAACATAACTATCACTTATCAAGGNCTTTTC 21690     21700     21710     21720     21730     21740     21750     21760
                    ....|....|....|....|....|....|....|....|....|....|....|....|....|....|....|....|
HCoV-SA1    CCTATCAGGGAGACCATGGTGATAAGTTTACTTGCAGGACAAGCTACAGGACAACTCCACAAAAGTNGTTTGTA 21770     21780     21790     21800     21810     21820     21830     21840
                    ....|....|....|....|....|....|....|....|....|....|....|....|....|....|....|....|
HCoV-SA1    GCTAACTATTCTCAGGACGTCAACAGTTTGCTAATGGGTTTTGCGTCCGTATAGGAGCAGCTGCCAATTCCACGGGCAC 21850     21860     21870     21880     21890     21900     21910     21920
                    ....|....|....|....|....|....|....|....|....|....|....|....|....|....|....|....|
HCoV-SA1    TGTTATTATTAGCCCAATCTACCAGCGCTACTAATACGAAAAATTTACCCTGCTTTTATGCHGGGTTCTCAGTTGGTAATT 21930     21940     21950     21960     21970     21980     21990     22000
                    ....|....|....|....|....|....|....|....|....|....|....|....|....|....|....|....|
HCoV-SA1    TCTCAGATGGTAAAAGGGCCGCTTCCTTCAATCAAACTCTCAGTTCTTCCCGAAGTGTGGCACTTACTTAGAGCT 22010     22020     22030     22040     22050     22060     22070     22080
                    ....|....|....|....|....|....|....|....|....|....|....|....|....|....|....|....|
HCoV-SA1    TCTCAGATGGTAAAAGGGCCGCTTCCTTCAATCAAACTCTCAGTTCTTCCCGAAGTGTGGCACTTACTTAGAGCT 22090     22100     22110     22120     22130     22140     22150     22160
                    ....|....|....|....|....|....|....|....|....|....|....|....|....|....|....|....|
HCoV-SA1    TTTTATTGTATTCTAGAGCCTCGCTTGGAAATCATTGTCCTGCTGGCAATTCCTACTTCCTTTTGCCACTATCACAC 22170     22180     22190     22200     22210     22220     22230     22240
                    ....|....|....|....|....|....|....|....|....|....|....|....|....|....|....|....|
HCoV-SA1    TCCTGCAACAGATTGTTCTGATGGCAATTACAATTACCGGAAGATGATGATTTAGAGTCTGGCAATTACACAACTTAATTTAACGTA 22250     22260     22270     22280     22290     22300     22310     22320
                    ....|....|....|....|....|....|....|....|....|....|....|....|....|....|....|....|
HCoV-SA1    ACTGCACCTTCTATGTACACTTATAACATTACCGGTATATGTTGATTTGATTGTACACGCCGCAATATGTTCAATTTGCCACCTTGCCACCTGCCTGTTTATGATAC 22330     22340     22350     22360     22370     22380     22390     22400
                    ....|....|....|....|....|....|....|....|....|....|....|....|....|....|....|....|
HCoV-SA1    GTTCACCCTCTTCTCAACTCCGGTATGTGTTGATTGGTACGACGCGGCAATATGTTCAATTTGCCACCTGCCACCTGCCACCTGCCTGTTTATGATAC

```
                  28810     28820     28830     28840     28850     28860     28870     28880
              ....|....|....|....|....|....|....|....|....|....|....|....|....|....|....|....|
HCoV-SA1      GAGACAGGACAGAAAAATTAATACCGGGAATGGAATTAAGCAACTGGCTCCCAGGTGGTACTTCTACTACACTGGAACTG 28890     28900     28910     28920     28930     28940     28950     28960
              ....|....|....|....|....|....|....|....|....|....|....|....|....|....|....|....|
HCoV-SA1      GACCCGAAGCAGCACTCCCATTCCGGGCTGTTAAGGATGGCATCGTTTGGGTCCATGAAGATGGCGCCACTGATGCTCCT 28970     28980     28990     29000     29010     29020     29030     29040
              ....|....|....|....|....|....|....|....|....|....|....|....|....|....|....|....|
HCoV-SA1      TCAACTTTTGGGACGCGGAACCCTAACAATGATTCAGCTATTGTTACACAATTCGCGCCCGGTACTAAGCTTCCTAAAAA 29050     29060     29070     29080     29090     29100     29110     29120
              ....|....|....|....|....|....|....|....|....|....|....|....|....|....|....|....|
HCoV-SA1      CTTCCACATTGAGGGGACTGGAGGCAATAGTCAATCATCTTCAAGAGCCTCTAGCTTAAGCAGAAACTCTTCCAGATCTA 29130     29140     29150     29160     29170     29180     29190     29200
              ....|....|....|....|....|....|....|....|....|....|....|....|....|....|....|....|
HCoV-SA1      GTTCACAAGGTTCAAGATCAGGAAACTCTACCCGCGGCACTTCTCCAGGTCCATCTGGAATCGGAGCAGTAGGAGGTGAT 29210     29220     29230     29240     29250     29260     29270     29280
              ....|....|....|....|....|....|....|....|....|....|....|....|....|....|....|....|
HCoV-SA1      CTACTTTACCTTGATCTTCTGAACAGACTACAAGCCCTTGAGTCTGGCAAAGTAAAGCAATCGCAGCCAAAAGTAATCAC 29290     29300     29310     29320     29330     29340     29350     29360
              ....|....|....|....|....|....|....|....|....|....|....|....|....|....|....|....|
HCoV-SA1      TAAGAAAGATGCTGCTGCTGCTAAAAATAAGATGCGCCACAAGCGCACTTCCACCAAAAGTTTCAACATGGTGCAAGCTT 29370     29380     29390     29400     29410     29420     29430     29440
              ....|....|....|....|....|....|....|....|....|....|....|....|....|....|....|....|
HCoV-SA1      TTGGTCTTCGCGGACCAGGAGACCTCCAGGGAAACTTTGGTGATCTTCAATTGAATAAACTCGGCACTGAGGACCCACGT 29450     29460     29470     29480     29490     29500     29510     29520
              ....|....|....|....|....|....|....|....|....|....|....|....|....|....|....|....|
HCoV-SA1      TGGCCCCAAATTGCTGAGCTTGCTCCTACAGCCAGTGCTTTTATGGGTATGTCGCAATTTAAACTTACCCATCAGAACAA 29530     29540     29550     29560     29570     29580     29590     29600
              ....|....|....|....|....|....|....|....|....|....|....|....|....|....|....|....|
HCoV-SA1      TGATGATCATGGCAACCCTGTGTACTTCCTTCGGTACAGTGGAGCCATTAAACTTGACCCAAAGAATCCCAACTACAATA
```

Fig. 14, Cont'd

```
              29610     29620     29630     29640     29650     29660     29670     29680     29690
          ....|....|....|....|....|....|....|....|....|....|....|....|....|....|....|....|....|
HCoV-SA1  AGTGGTTGGAGCTTCCTGAGAACAAAATATTGATGCCTAC

Fig. 15

```
5'  AATATTCTCCTGCGCAAGTATGGCCGTGGTGGTTATCACTACACCCCATTCCACTATGAGCGAGACAACA
0   +---+---+---+---+---+---+---+---+---+---+---+---+---+---+---+---+---+---+---+---+   770
1   K  Y  S  P  A  Q  V  W  P  W  W  L  S  L  H  P  I  P  L  .  A  R  Q  H
2   N  I  L  L  R  K  Y  G  R  G  G  Y  H  Y  T  P  F  H  Y  E  R  D  N
3   I  F  S  C  A  S  M  A  V  V  I  T  T  P  H  S  T  M  S  E  T  T

5'  CCTCTTGCCCTGAGTGGATGGACGATTTTGAGGCGGATCCTAAAGGCAAATATGCCCAGAATCTGCTTAA
0   +---+---+---+---+---+---+---+---+---+---+---+---+---+---+---+---+---+---+---+---+   840
1   L  L  P  .  V  D  G  R  F  .  G  G  S  .  R  Q  I  C  P  E  S  A  .
2   T  S  C  P  E  W  M  D  D  F  E  A  D  P  K  G  K  Y  A  Q  N  L  L  K
3   P  L  A  L  S  G  W  T  I  L  R  R  I  L  K  A  N  M  P  R  I  C  L

5'  GAAGTTGATTGGCGGTGATGTCACTCCAGTTGACCAATACATGTGTGGCGTTGATGGAAAACCCATTAGT
0   +---+---+---+---+---+---+---+---+---+---+---+---+---+---+---+---+---+---+---+---+   910
1   E  V  D  W  R  .  C  H  S  S  .  P  I  H  V  W  R  .  W  K  T  H  .
2   K  L  I  G  G  D  V  T  P  V  D  Q  Y  M  C  G  V  D  G  K  P  I  S
3   R  S  .  L  A  V  M  S  L  Q  L  T  N  T  C  V  A  L  M  E  N  P  L  V

5'  GCCTACGCATTTTTAATGGCCAAGGATGGAATAACCAAACTGGCTGATGTTGAAGCGGACGTCGCAGCAC
0   +---+---+---+---+---+---+---+---+---+---+---+---+---+---+---+---+---+---+---+---+   980
1   C  L  R  I  F  N  G  Q  G  W  N  N  Q  T  G  .  C  .  S  G  R  R  S  T
2   A  Y  A  F  L  M  A  K  D  G  I  T  K  L  A  D  V  E  A  D  V  A  A
3   P  T  H  F  .  W  P  R  M  E  .  P  N  W  L  M  L  K  R  T  S  Q  H

5'  GTGCTGATGACGAAGGCTTCATCACATTAAAGAACAATCTATATAGATTGGTTTGGCATGTTGAGCGTAA
0   +---+---+---+---+---+---+---+---+---+---+---+---+---+---+---+---+---+---+---+---+   1050
1   C  .  .  R  R  L  H  H  I  K  E  Q  S  I  .  I  G  L  A  C  .  A  .
2   A  D  D  E  G  F  I  T  L  K  N  N  L  Y  R  L  V  W  H  V  E  R  K
3   V  L  M  T  K  A  S  S  H  .  R  T  I  Y  I  D  W  F  G  M  L  S  V

5'  AGACGTTCCATATCCTAAGCAATCTATTTTTACTATTAATAGTGTGGTCCAAAAGGATGGTGTTGAAAAC
0   +---+---+---+---+---+---+---+---+---+---+---+---+---+---+---+---+---+---+---+---+   1120
1   R  R  S  I  S  .  A  I  Y  F  Y  Y  .  .  C  G  P  K  G  W  C  .  K
2   D  V  P  Y  P  K  Q  S  I  F  T  I  N  S  V  V  Q  K  D  G  V  E  N
3   K  T  F  H  I  L  S  N  L  F  L  L  L  I  V  W  S  K  R  M  V  L  K  T

5'  ACTCCTCCTCACTATTTTACTCTTGGATGCAAAATTTTAACGCTCACCCCACGCAACAAGTGGAGTGGCG
0   +---+---+---+---+---+---+---+---+---+---+---+---+---+---+---+---+---+---+---+---+   1190
1   H  S  S  S  L  F  Y  S  W  M  Q  N  F  N  A  H  P  T  Q  Q  V  E  W  R
2   T  P  P  H  Y  F  T  L  G  C  K  I  L  T  L  T  P  R  N  K  W  S  G
3   L  L  L  T  I  L  L  L  D  A  K  F  .  R  S  P  H  A  T  S  G  V  A

5'  TTTCTGACTTGTCCCTCAAACAAAAACTCCTTTACACCTTCTATGGTAAGGAGTCACTTGAGAACCCAAC
0   +---+---+---+---+---+---+---+---+---+---+---+---+---+---+---+---+---+---+---+---+   1260
1   F  .  L  V  P  Q  T  K  T  P  L  H  L  L  W  .  G  V  T  .  E  P  N
2   V  S  D  L  S  L  K  Q  K  L  L  Y  T  F  Y  G  K  E  S  L  E  N  P  T
3   F  L  T  C  P  S  N  K  N  S  F  T  P  S  M  V  R  S  H  L  R  T  Q

5'  CTACATTTACCACTCCGCATTCATTGAGTGTGGAAGTTGTGGTAATGATTCCTGGCTTACAGGGAATGCT
0   +---+---+---+---+---+---+---+---+---+---+---+---+---+---+---+---+---+---+---+---+   1330
1   L  H  L  P  L  R  I  H  .  V  W  K  L  W  .  .  F  L  A  Y  R  E  C
2   Y  I  Y  H  S  A  F  I  E  C  G  S  C  G  N  D  S  W  L  T  G  N  A
3   P  T  F  T  T  P  H  S  L  S  V  E  V  V  V  M  I  P  G  L  Q  G  M  L

5'  ATCCAAGGGTTTGCCTGTGGATGTGGGGCATCATATACAGCTAATGATGTCGAAGTCCAATCATCTGGCA
0   +---+---+---+---+---+---+---+---+---+---+---+---+---+---+---+---+---+---+---+---+   1400
1   Y  P  R  V  C  L  W  M  W  G  I  I  Y  S  .  .  C  R  S  P  I  W  H
2   I  Q  G  F  A  C  G  C  G  A  S  Y  T  A  N  D  V  E  V  Q  S  S  G
3   S  K  G  L  P  V  D  V  G  H  H  I  Q  L  M  M  S  K  S  N  H  L  A
```

```
5'    TGCTAACACTAAAGTTCTTAGGAACAAGGGTGTTGATTATACTAAGAAGTTTCTTACAGTTGACGGTGTG
0     +----+----+----+----+----+----+----+----+----+----+----+----+----+----+    4270
1       C  .  H  .  S  S  .  E  Q  G  C  .  L  Y  .  E  V  S  Y  S  .  R  C
2        A  N  T  K  V  L  R  N  K  G  V  D  Y  T  K  K  F  L  T  V  D  G  V
3     L  L  T  L  K  F  L  G  T  R  V  L  I  L  R  S  F  L  G  L  T  V  C
0

5'    CAATATTATTGCTACACGTCTAAGGACACTTTAGATGATATCTTACAACAGGCTAATAAGTCTGTTGGTA
0     +----+----+----+----+----+----+----+----+----+----+----+----+----+----+    4340
1      A  I  L  L  L  H  V  .  G  H  F  R  .  Y  L  T  T  G  .  V  C  W  Y
2       Q  Y  Y  C  Y  T  S  K  D  T  L  D  D  I  L  Q  Q  A  N  K  S  V  G
3     N  I  I  A  T  R  L  R  T  L  .  M  I  S  Y  N  R  L  I  S  L  L  V
0

5'    TTATATCTATGCCTTTGGGATATGTGTCTCATGGTTTAGACTTAATGCAAGCAGGGAGTGTCGTGCGTAG
0     +----+----+----+----+----+----+----+----+----+----+----+----+----+----+    4410
1      Y  I  Y  A  F  G  I  C  V  S  W  F  R  L  N  A  S  R  E  C  R  A  .
2       I  I  S  M  P  L  G  Y  V  S  H  G  L  D  L  M  Q  A  G  S  V  V  R
3     L  Y  L  C  L  W  D  M  C  L  M  V  .  T  .  C  K  Q  G  V  S  C  V
0

5'    AGTTAACGTGCCCTACGTGTGTCTCCTAGCTAATAAAGAGCAAGAAGCTATTTTGATGTCTGAAGACGTT
0     +----+----+----+----+----+----+----+----+----+----+----+----+----+----+    4480
1      S  .  R  A  L  R  V  S  P  S  .  R  A  R  S  Y  F  D  V  .  R  R
2       V  N  V  P  Y  V  C  L  L  A  N  K  E  Q  E  A  I  L  M  S  E  D  V
3     E  L  T  C  P  T  C  V  S  .  L  I  K  S  K  K  L  F  .  C  L  K  T  L
0

5'    AAGTTAAACCCTTCAGAAGATTTTATAAAGCACGTCCGCACTAATGGTGGTTACAATTCTTGGCATTTAG
0     +----+----+----+----+----+----+----+----+----+----+----+----+----+----+    4550
1      .  V  K  P  F  R  R  F  Y  K  A  R  P  H  .  W  W  L  Q  F  L  A  F  S
2       K  L  N  P  S  E  D  F  I  K  H  V  R  T  N  G  G  Y  N  S  W  H  L
3     S  .  T  L  Q  K  I  L  .  S  T  S  A  L  M  V  V  T  I  L  G  I  .
0

5'    TCGAGGGTGAACTATTGGTGCAAGACTTACGCTTAAATAAGCTCCTGCATTGGTCTGATCAAACCATATG
0     +----+----+----+----+----+----+----+----+----+----+----+----+----+----+    4620
1      R  G  .  T  I  G  A  R  L  T  L  K  .  A  P  A  L  V  .  S  N  H  M
2       V  E  G  E  L  L  V  Q  D  L  R  L  N  K  L  L  H  W  S  D  Q  T  I  C
3     S  R  V  N  Y  W  C  K  T  Y  A  .  I  S  S  C  I  G  L  I  K  P  Y
0

5'    CTACAAGGATAGTGTGTTTTATGTTGTAAAGAATAGTACAGCTTTTCCATTTGAAACACTTTCAGCATGT
0     +----+----+----+----+----+----+----+----+----+----+----+----+----+----+    4690
1      L  Q  G  .  C  V  L  C  C  K  E  .  Y  S  F  S  I  .  N  T  F  S  M
2       Y  K  D  S  V  F  Y  V  V  K  N  S  T  A  F  P  F  E  T  L  S  A  C
3     A  T  R  I  V  C  F  M  L  .  R  I  V  Q  L  F  H  L  K  H  F  Q  H  V
0

5'    CGTGCGTATTTGGATTCACGCACGACACAGCAGTTAACAATCGAAGTCTTAGTGACTGTCGATGGTGTAA
0     +----+----+----+----+----+----+----+----+----+----+----+----+----+----+    4760
1      S  C  V  F  G  F  T  H  D  T  A  V  N  N  R  S  L  S  D  C  R  W  C  K
2       R  A  Y  L  D  S  R  T  T  Q  Q  L  T  I  E  V  L  V  T  V  D  G  V
3     V  R  I  W  I  H  A  R  H  S  S  .  Q  S  K  S  .  .  L  S  M  V  .
0

5'    ATTTTAGAACAGTCGTTCTAAATAATAAGAACACTTATAGATCACAGCTTGGATGCGTTTTCTTTAATGG
0     +----+----+----+----+----+----+----+----+----+----+----+----+----+----+    4830
1      F  .  N  S  R  S  K  .  E  H  L  .  I  T  A  W  M  R  F  L  .  W
2       N  F  R  T  V  V  L  N  N  K  N  T  Y  R  S  Q  L  G  C  V  F  F  N  G
3     I  L  E  Q  S  F  .  I  I  R  T  L  I  D  H  S  L  D  A  F  S  L  M
0

5'    TGCTGATATTTCTGACACCATTCCTGATGAGAAACAGAATGGTCACAGTTTATATCTAGCAGACAATTTG
0     +----+----+----+----+----+----+----+----+----+----+----+----+----+----+    4900
1      C  .  Y  F  .  H  H  S  .  E  T  E  W  S  Q  F  I  S  S  R  Q  F
2       A  D  I  S  D  T  I  P  D  E  K  Q  N  G  H  S  L  Y  L  A  D  N  L
3     V  L  I  F  L  T  P  F  L  M  R  N  R  M  V  T  V  Y  I  .  Q  T  I  .
0
```

```
5'  TCCCGTTGTTGAGTATCTGTCTAAAGAAGACCTACATACATTGTATGTAGACCCTAAGTATCAAGTCATT
 o  +---+---+---+---+---+---+---+---+---+---+---+---+---+---+---+---+---+---+---+---+   6370
 1    S  R  C  .  V  S  V  .  R  R  P  T  Y  I  V  C  R  P  .  V  S  S  H
 2   P  V  V  E  Y  L  S  K  E  D  L  H  T  L  Y  V  D  P  K  Y  Q  V  I
 3  L  P  L  L  S  I  C  L  K  K  T  Y  I  H  C  M  .  T  L  S  I  K  S  L
 o

5'  GTCTTAAAAGACAATGTACTTTCTTCTATGCTTAGATTGCACACCGTTGAGTCAGGTGATATTAACGTTG
 o  +---+---+---+---+---+---+---+---+---+---+---+---+---+---+---+---+---+---+---+---+   6440
 1    C  L  K  R  Q  C  T  F  F  Y  A  .  I  A  H  R  .  V  R  .  Y  .  R  C
 2   V  L  K  D  N  V  L  S  S  M  L  R  L  H  T  V  E  S  G  D  I  N  V
 3  S  .  K  T  M  Y  F  L  L  C  L  D  C  T  P  L  S  Q  V  I  L  T  L
 o

5'  TTGCAGCTTCCGGATCTTTGACACGTAAAGTGAAGTTACTATTTAGGGCTTCATTTTATTTCAAAGAATT
 o  +---+---+---+---+---+---+---+---+---+---+---+---+---+---+---+---+---+---+---+---+   6510
 1    C  S  F  R  I  F  D  T  .  S  E  V  T  I  .  G  F  I  L  F  Q  R  I
 2   V  A  A  S  G  L  T  R  K  V  K  L  L  F  R  A  S  F  Y  F  K  E  F
 3  L  Q  L  P  D  L  .  H  V  K  .  S  Y  Y  L  G  L  H  F  I  S  K  N
 o

5'  TGCTACCCGCACTTTCACTGCTACCACTGCTGTAGGTAGTTGTATAAAGAGTGTAGTGCGGCATCTAGGT
 o  +---+---+---+---+---+---+---+---+---+---+---+---+---+---+---+---+---+---+---+---+   6580
 1    C  Y  P  H  F  H  C  Y  H  C  C  R  .  L  Y  K  E  C  S  A  A  S  R
 2   A  T  R  T  F  T  A  T  T  A  V  G  S  C  I  K  S  V  V  R  H  L  G
 3  L  L  P  A  L  S  L  L  P  L  L  .  V  V  V  .  R  V  .  C  G  I  .  V
 o

5'  GTTACTAAAGGCATATTGACAGGCTGTTTTAGTTTTGCCAAGATGTTATTTATGCTTCCACTAGCTTACT
 o  +---+---+---+---+---+---+---+---+---+---+---+---+---+---+---+---+---+---+---+---+   6650
 1    C  Y  .  R  H  I  D  R  L  F  .  F  C  Q  D  V  I  Y  A  S  T  S  L  L
 2   V  T  K  G  I  L  T  G  C  F  S  F  A  K  M  L  F  M  L  P  L  A  Y
 3  L  L  K  A  Y  .  Q  A  V  L  V  L  P  R  C  Y  L  C  F  H  .  L  T
 o

5'  TTAGTGATTCAAAACTCGGCACCACAGAGGTTAAAGTGAGTGCTTTGAAAACAGCCGGCGTTGTGACAGG
 o  +---+---+---+---+---+---+---+---+---+---+---+---+---+---+---+---+---+---+---+---+   6720
 1    .  F  K  T  R  H  H  R  G  .  S  E  C  F  E  N  S  R  R  C  D  R
 2   F  S  D  S  K  L  G  T  T  E  V  K  V  S  A  L  K  T  A  G  V  V  T  G
 3  L  V  I  Q  N  S  A  P  Q  R  L  K  .  V  L  .  K  Q  P  A  L  .  Q
 o

5'  TAATGTTGTAAAACAGTGTTGCACTGCTGCTGTTGATTTAAGTATGGATAAGTTGCGCCGTGTGGATTGG
 o  +---+---+---+---+---+---+---+---+---+---+---+---+---+---+---+---+---+---+---+---+   6790
 1    .  C  C  K  T  V  L  H  C  C  C  .  F  K  Y  G  .  V  A  P  C  G  L
 2   N  V  V  K  Q  C  T  A  A  V  D  L  S  M  D  K  L  R  R  V  D  W
 3  V  M  L  .  N  S  V  A  L  L  L  L  .  V  W  I  S  C  A  V  W  I  G
 o

5'  AAATCAACCCTACGGTTGTTACTTATGTTATGCACAACTATGGTATTGTTGTCTTCTGTGTATCACTTGT
 o  +---+---+---+---+---+---+---+---+---+---+---+---+---+---+---+---+---+---+---+---+   6860
 1    E  I  N  P  T  V  V  T  Y  V  M  H  N  Y  G  I  V  V  F  C  V  S  L  V
 2   K  S  T  L  R  L  L  L  M  L  C  T  M  V  L  S  S  V  H  L
 3  N  Q  P  Y  G  C  Y  L  C  Y  A  Q  L  W  Y  C  C  L  L  C  I  T  C
 o

5'  ATGTCTTCAATCAGGTCTTATCAAGTGATGTTATGTTTGAAGATGCCCAAGGTTTGAAAAAGTTCTACAA
 o  +---+---+---+---+---+---+---+---+---+---+---+---+---+---+---+---+---+---+---+---+   6930
 1    C  L  Q  S  G  L  I  K  .  C  Y  V  .  R  C  P  R  F  E  K  V  L  Q
 2   Y  V  F  N  Q  V  L  S  S  D  V  M  F  E  D  A  Q  G  L  K  K  F  Y  K
 3  M  S  S  I  R  S  Y  Q  V  M  L  C  L  K  M  P  K  V  .  K  S  S  T
 o

5'  AGAAGTTAGAGCTTACCTAGGAATCTCTTCTGCTTGTGACGGTCTTGCTTCAGCTTATAGGGCGAATTCC
 o  +---+---+---+---+---+---+---+---+---+---+---+---+---+---+---+---+---+---+---+---+   7000
 1    R  S  .  S  L  P  R  N  L  F  C  L  .  R  S  C  F  S  L  .  G  E  F
 2   E  V  R  A  Y  L  G  I  S  S  A  C  D  G  L  A  S  A  Y  R  A  N  S
 3  K  K  L  E  L  T  .  E  S  L  L  L  V  T  V  L  L  Q  L  I  G  R  I  P
 o
```

```
5'   TAAGTGTAATTTAGCTTTCCGGTTAACCACCTCAAAGCTACGCGCTAATGATAATATCTTATCAGTTAGA
0    +++++|++++|++++|++++|++++|++++|++++|++++|++++|++++|++++|++++|++++|++++|  8470
1        .   V   .   F   S   F   P   V   N   H   L   K   A   T   R   .       .   Y   L   I   S   .
2        K   C   N   L   A   F   R   L   T   T   S   K   L   R   A   N   D   N   I   L   S   V   R
3    V   S   V   I   .   L   S   G   .   P   P   Q   S   Y   A   L   M   I   .   S   Y   Q   L   D
0

5'   TTCACTGCTAACAAAATTGTTGGTGGTGCTCCTACATGGTTTAATGCGTTGCGTGACTTTACGTTAAAGG
0    +++++|++++|++++|++++|++++|++++|++++|++++|++++|++++|++++|++++|++++|++++|  8540
1    I   H   C   .   Q   N   C   W   W   C   S   .   Y   M   V   .   C   V   A   .   L   Y   V   K   G
2        F   T   A   N   K   I   V   G   G   A   P   T   W   F   N   A   L   R   D   F   T   L   K
3        S   L   L   T   K   L   L   V   V   L   L   H   G   L   M   R   C   V   T   L   R   .   R
0

GTTATGTTCTTGCTACCATTATGTGTTTCTGTGTGCTGTACTGATGTATTTGTGTTACCTACATTTTC
0    +++++|++++|++++|++++|++++|++++|++++|++++|++++|++++|++++|++++|++++|++++|  8610
1        L   C   S   C   Y   H   Y   C   V   S   V   C   C   T   D   V   F   V   .   Y   L   .   .       F
2    G   Y   V   L   A   T   I   I   V   F   L   C   A   V   L   M   Y   L   C   L   P   T   F   S
3    V   M   F   L   L   P   L   L   C   F   C   V   L   Y   .   C   .   C   V   Y   L   H   F
0

5'   TATGGCACCTGTTGAATTTTATGAAGACCGCATCTTGGACTTTAAAGTTCTTGATAATGGTATCATTAGG
0    +++++|++++|++++|++++|++++|++++|++++|++++|++++|++++|++++|++++|++++|++++|  8680
1    Y   G   T   C   .   I   L   .       R   P   H   L   G   L   .   S   S   .   W   Y   H   .
2        M   A   P   V   E   F   Y   E   D   R   I   L   D   F   K   V   L   D   N   G   I   R
3    L   W   H   L   L   N   F   M   K   T   A   S   W   T   L   K   F   L   I   M   V   S   L   G
0

5'   GATGTAAATCCTGATGATAAGTGCTTTGCTAATAAGCACCGGTCCTTCACACAATGGTATCATGAGCATG
0    +++++|++++|++++|++++|++++|++++|++++|++++|++++|++++|++++|++++|++++|++++|  8750
1    G   C   K   S   .       V   L   C   .       A   P   V   L   H   T   M   V   S   .   A   C
2    D   V   N   P   D   D   K   C   F   A   N   K   H   R   S   F   T   Q   W   Y   H   E   H
3    M   .   I   L   M   I   S   A   L   L   I   S   T   G   P   S   H   N   G   I   M   S   M
0

5'   TTGGTGGTGTCTATGACAACTCTATCACATGCCCATTGACAGTTGCAGTAATTGCTGGAGTTGCTGGTGC
0    +++++|++++|++++|++++|++++|++++|++++|++++|++++|++++|++++|++++|++++|++++|  8820
1    W   W   C   L   .   Q   L   Y   H   M   P   I   D   S   C   S   N   C   W   S   C   W   C
2    V   G   G   V   Y   D   N   S   I   T   C   P   L   T   V   A   V   I   A   G   V   A   G   A
3    L   V   V   S   M   T   T   L   S   H   A   H   .   Q   L   Q   .   L   L   E   L   L   V
0

5'   TCGCATTCCAGACGTACCTACTACATTGGCTTGGGTGAACAATCAGATAATTTTCTTTGTTTCTCGAGTC
0    +++++|++++|++++|++++|++++|++++|++++|++++|++++|++++|++++|++++|++++|++++|  8890
1        S   H   S   R   R   T   Y   Y   I   G   L   G   E   Q   S   D   N   F   L   C   F   S   S
2        R   I   P   D   V   P   T   T   L   A   W   V   N   N   Q   I   I   F   F   V   S   R   V
3    L   A   F   Q   T   Y   L   L   H   W   L   G   .   T   I   R   .       F   S   L   F   L   E   S
0

5'   TTTGCTAATACAGGCAGTGTTTGCTACACTCCTATAGATGAGATACCCTATAAGAGTTTCTCTGATAGTG
0    +++++|++++|++++|++++|++++|++++|++++|++++|++++|++++|++++|++++|++++|++++|  8960
1    L   C   .   Y   R   Q   C   L   L   H   S   Y   R   .   D   T   L   .   E   F   L   .   .   W
2        F   A   N   T   G   S   V   C   Y   T   P   I   D   E   I   P   Y   K   S   F   S   D   S
3        L   L   I   Q   A   V   F   A   T   L   L   .   M   R   Y   P   I   R   V   S   L   I   V
0

5'   GTTGCATTCTTCCATCTGAGTGCACTATGTTTAGGGATGCAGAGGGCCGTATGACACCATACTGCCATGA
0    +++++|++++|++++|++++|++++|++++|++++|++++|++++|++++|++++|++++|++++|++++|  9030
1        L   H   S   S   I   .       V   H   Y   V   .       G   C   R   G   P   Y   D   T   I   L   P   .
2        G   C   I   L   P   S   E   C   T   M   F   R   D   A   E   G   R   M   T   P   Y   C   H
3    V   A   F   F   H   L   S   A   L   C   L   G   M   Q   R   A   V   .   H   H   T   A   M
0

5'   TCCTACTGTTTTGCCTGGGGCTTTTGCGTACAGTCAGATGAGGCCTCATGTTCGTTACGACTTGTATGAT
0    +++++|++++|++++|++++|++++|++++|++++|++++|++++|++++|++++|++++|++++|++++|  9100
1        S   Y   C   F   A   W   G   F   C   V   Q   S   D   E   A   S   C   S   L   R   L   V   .
2        P   T   V   L   P   G   A   F   A   Y   S   Q   M   R   P   H   V   R   Y   D   L   Y   D
3    I   L   L   F   C   L   G   L   L   R   T   V   R   .   G   L   M   F   V   T   T   C   M   M
0
```

Fig. 15, Cont'd

Fig. 15, Cont'd

```
5'  CTTATGCAGCTCTTAGAAACTCTTTAACTAATGATGCCTATTCACGATTTTTGGGGTTGTTTAACAAGTA
o   +----+----+----+----+----+----+----+----+----+----+----+----+----+----+  9870
1       L   C   S   S   .   K   L   F   N   .   C   L   F   T   I   F   G   V   V   .   Q   V
2     T   Y   A   A   L   R   N   S   L   T   N   D   A   Y   S   R   F   L   G   L   F   N   K   Y
3   L   M   Q   L   L   E   T   L   .   L   M   M   P   I   H   D   F   W   G   C   L   T   S
o
5'  TAAGTACTTCTCTGGTGCTATGGAAACAGCCGCTTATCGTGAAGCTGCAGCATGTCATCTTGCTAAAGCC
o   +----+----+----+----+----+----+----+----+----+----+----+----+----+----+  9940
1       .   V   L   L   W   C   Y   G   N   S   R   L   S   .   S   C   S   M   S   S   C   .   S
2     K   Y   F   S   G   A   M   E   T   A   A   Y   R   E   A   A   A   C   H   L   A   K   A
3   I   S   T   S   L   V   L   W   K   Q   P   L   I   V   K   L   Q   H   V   I   L   L   K   P
o
5'  TTACAAACATACAGCGAGACTGGTAGTGATCTTCTTTACCAACCACCCAACTGTAGCATAACCTCTGGCG
o   +----+----+----+----+----+----+----+----+----+----+----+----+----+----+  10010
1       L   T   N   I   Q   R   D   W   .   S   S   L   P   T   T   Q   L   .   H   N   L   W   R
2     L   Q   T   Y   S   E   T   G   S   D   L   L   Y   Q   P   P   N   C   S   I   T   S   G
3   Y   K   H   T   A   R   L   V   V   I   F   F   T   N   H   P   T   V   A   .   P   L   A
o
5'  TGTTGCAAAGCGGTTTGGTGAAAATGTCACATCCCAGTGGAGATGTTGAGGCTTGTATGGTTCAGGTTAC
o   +----+----+----+----+----+----+----+----+----+----+----+----+----+----+  10080
1       V   A   K   R   F   G   E   N   V   T   S   Q   W   R   C   .   G   L   Y   G   S   G   Y
2     V   L   Q   S   G   L   V   K   M   S   H   P   S   G   D   V   E   A   C   M   V   Q   V   T
3   C   C   K   A   V   W   .   K   C   H   I   P   V   E   M   L   R   L   V   W   F   R   L
o
5'  CTGCGGTAGCATGACTCTTAATGGTCTTTGGCTTGACAACACAGTCTGGTGCCCACGACACGTAATGTGC
o   +----+----+----+----+----+----+----+----+----+----+----+----+----+----+  10150
1       L   R   .   H   D   S   .   W   S   L   A   .   Q   H   S   L   V   P   T   T   R   N   V
2     C   G   S   M   T   L   N   G   L   W   L   D   N   T   V   W   C   P   R   H   V   M   C
3   P   A   V   A   .   L   L   M   V   F   G   L   T   T   Q   S   G   A   H   D   T   .   C   A
o
5'  CCGGCTGACCAGTTGTCTGATCCTAATTATGATGCCTTGTTGATTTCTATGACTAATCATAGTTTCAGTG
o   +----+----+----+----+----+----+----+----+----+----+----+----+----+----+  10220
1       P   G   .   P   V   V   S   .   L   .   C   L   V   D   F   Y   D   .   S   .   F   Q   C
2     P   A   D   Q   L   S   D   P   N   Y   D   A   L   L   I   S   M   T   N   H   S   F   S
3   R   L   T   S   C   L   I   L   I   M   M   P   C   .   F   L   .   L   I   I   V   S   V
o
5'  TGCAAAAACACATTGGCGCTCCAGCAAACTTGCGTGTTGTTGGTCATGCCATGCAAGGCACTCTTTTGAA
o   +----+----+----+----+----+----+----+----+----+----+----+----+----+----+  10290
1       .   A   K   T   H   W   R   S   S   K   L   A   C   C   W   S   C   H   A   R   H   S   F   E
2     V   Q   K   H   I   G   A   P   A   N   L   R   V   V   L   V   M   P   C   K   A   L   L   K
3   C   K   N   T   L   A   L   Q   Q   T   C   V   L   L   V   M   P   C   K   A   L   F   .
o
5'  GTTGACTGTCGATGTTGCTAACCCTAGCACTCCAGCCTACACTTTTACAACAGTGAAACCTGGCGCAGCA
o   +----+----+----+----+----+----+----+----+----+----+----+----+----+----+  10360
1       V   D   C   R   C   C   .   P   .   H   S   S   L   H   F   Y   N   S   E   T   W   R   S
2     L   T   V   D   V   A   N   P   S   T   P   A   Y   T   F   T   T   V   K   P   G   A   A
3   S   .   L   S   M   L   L   T   L   A   L   Q   P   T   L   L   Q   Q   .   N   L   A   Q   H
o
5'  TTTAGTGTGTTAGCATGCTATAATGGTCGTCCGACTGGTACATTCACTGTTGTAATGCGCCCTAACTACA
o   +----+----+----+----+----+----+----+----+----+----+----+----+----+----+  10430
1       I   .   C   V   S   M   L   .   W   S   S   D   W   Y   I   H   C   C   N   A   P   .   L   H
2     F   S   V   L   A   C   Y   N   G   R   P   T   G   T   F   T   V   V   M   R   P   N   Y
3   L   V   C   .   H   A   I   M   V   V   R   L   V   H   S   L   L   .   C   A   L   T   T
o
5'  CAATTAAGGGTTCCTTTCTGTGTGGTTCTTGTGGTAGTGTTGGTTACACCAAGGAGGGTAGTGTGATCAA
o   +----+----+----+----+----+----+----+----+----+----+----+----+----+----+  10500
1       N   .   G   F   L   S   V   W   F   L   W   .   C   W   L   H   Q   G   G   .   C   D   Q
2     T   I   K   G   S   F   L   C   G   S   C   G   S   V   G   Y   T   K   E   G   S   V   I   N
3   Q   L   R   V   P   F   C   V   V   L   V   V   V   L   V   T   P   R   R   V   .   S
o
```

Fig. 15, Cont'd

```
5'  TTTCTGTTACATGCATCAAATGGAACTTGCTAATGGTACACATACCGGTTCAGCATTTGATGGTACTATG
0   +----+----+----+----+----+----+----+----+----+----+----+----+----+----+  10570
1     F  L  L  H  A  S  N  G  T  C  .  W  Y  T  Y  R  F  S  I  .  W  Y  Y
2    F  C  Y  M  H  Q  M  E  L  A  N  G  T  H  T  G  S  A  F  D  G  T  M
3   I  S  V  T  C  I  K  W  N  L  L  M  V  H  I  P  V  Q  H  L  M  V  L  C
0

5'  TATGGTGCCTTTATGGATAAACAAGTGCACCAAGTTCAGTTAACAGACAAATACTGCAGTGTTAATGTAG
0   +----+----+----+----+----+----+----+----+----+----+----+----+----+----+  10640
1     V  W  C  L  Y  G  .  T  S  A  P  S  S  V  N  R  Q  I  L  Q  C  .  C  S
2    Y  G  A  F  M  D  K  Q  V  H  Q  V  Q  L  T  D  K  Y  C  S  V  N  V
3   M  V  P  L  W  I  N  K  C  T  K  F  S  .  Q  T  N  T  A  V  L  M  .
0

5'  TAGCTTGGCTTTACGCAGCAATACTTAATGGTTGCGCTTGGTTTGTAAAACCTAATCGCACTAGTGTTGT
0   +----+----+----+----+----+----+----+----+----+----+----+----+----+----+  10710
1     S  L  A  L  R  S  N  T  .  W  L  R  L  V  C  K  T  .  S  H  .  C  C
2    V  A  W  L  Y  A  A  I  L  N  G  C  A  W  F  V  K  P  N  R  T  S  V  V
3   .  L  G  F  T  Q  Q  Y  L  M  V  A  L  G  L  .  N  L  I  A  L  V  L
0

5'  TTCTTTTAATGAATGGGCTCTTGCCAACCAATTCACTGAATTTGTTGGCACTCAATCCGTTGACATGTTA
0   +----+----+----+----+----+----+----+----+----+----+----+----+----+----+  10780
1     F  F  .  .  M  G  S  C  Q  P  I  H  .  I  C  W  H  S  I  R  .  H  V
2    S  F  N  E  W  A  L  A  N  Q  F  T  E  F  V  G  T  Q  S  V  D  M  L
3   F  L  L  M  N  G  L  L  P  T  N  S  L  N  L  L  A  L  N  P  L  T  C  .
0

5'  GCTGTCAAAACAGGCGTTGCTATTGAACAGCTGCTTTATGCGATCCAACAACTGTATACTGGGTTCCAGG
0   +----+----+----+----+----+----+----+----+----+----+----+----+----+----+  10850
1     S  C  Q  N  R  R  C  Y  .  T  A  A  L  C  D  P  T  T  V  Y  W  V  P  G
2    A  V  K  T  G  V  A  I  E  Q  L  L  Y  A  I  Q  Q  L  Y  T  G  F  Q
3   L  S  K  Q  A  L  L  L  N  S  C  F  M  R  S  N  N  C  I  L  G  S  R
0

5'  GAAAGCAAATCCTTGGCAGTACCATGTTGGAAGATGAATTCACACCTGAGGATGTTAATATGCAGATTAT
0   +----+----+----+----+----+----+----+----+----+----+----+----+----+----+  10920
1     K  A  N  P  W  Q  Y  H  V  G  R  .  I  H  T  .  G  C  .  Y  A  D  Y
2    G  K  Q  I  L  G  S  T  M  L  E  D  E  F  T  P  E  D  V  N  M  Q  I  M
3   E  S  K  S  L  A  V  P  C  W  K  M  N  S  H  L  R  M  L  I  C  R  L
0

5'  GGGTGTGGTTATGCAGAGTGGTGTGAGAAAAGTTACATATGGTACTGCGCATTGGTTGTTTGCGACCCTT
0   +----+----+----+----+----+----+----+----+----+----+----+----+----+----+  10990
1     G  C  G  Y  A  E  W  C  E  K  S  Y  I  W  Y  C  A  L  V  V  C  D  P
2    G  V  V  M  Q  S  G  V  R  K  V  T  Y  G  T  A  H  W  L  F  A  T  L
3   W  V  W  L  C  R  V  V  .  E  K  L  H  M  V  L  R  I  G  C  L  R  P  L
0

5'  GTCTCAACCTATGTGATAATCTTACAAGCCACTAAATTTACTTTGTGGAACTACTTGTTTGAGACTATTC
0   +----+----+----+----+----+----+----+----+----+----+----+----+----+----+  11060
1     C  L  N  L  C  D  N  L  T  S  H  .  Y  F  V  E  L  L  V  .  D  Y  S
2    V  S  T  Y  V  I  I  L  Q  A  T  K  F  T  L  W  N  Y  L  F  E  T  I
3   S  Q  P  M  .  S  Y  K  P  L  N  L  L  C  G  T  T  C  L  R  L  F
0

5'  CCACACAGTTGTTCCCACTCTTATTTGTGACTATGGCCTTCGTTATGTTGTTGGTTAAACACAAACACAC
0   +----+----+----+----+----+----+----+----+----+----+----+----+----+----+  11130
1     H  T  V  V  P  T  L  I  C  D  Y  G  L  R  Y  V  V  G  .  T  Q  T  H
2    P  T  Q  L  F  P  L  L  F  V  T  M  A  F  V  M  L  L  V  K  H  K  H
3   P  H  S  C  S  H  S  Y  L  .  L  W  P  S  L  C  C  W  L  N  T  N  T
0

5'  CTTTTTGACACTTTTCTTGTTGCCTGTGGCTATTTGTTTGACTTATGCAAACATAGTCTACGAGCCCACT
0   +----+----+----+----+----+----+----+----+----+----+----+----+----+----+  11200
1     L  F  D  T  F  L  V  A  C  G  Y  L  F  D  L  C  K  H  S  L  R  A  H
2    F  L  T  L  F  L  L  P  V  A  I  C  L  T  Y  A  N  I  V  Y  E  P  T
3   P  F  .  H  F  S  C  C  L  W  L  F  V  .  L  M  Q  T  .  S  T  S  P  L
0
```

Fig. 15, Cont'd

```
5'   ACTCCCATTTCGTCAGCGCTGATTGCAGTTGCAAATTGGCTTGCCCCACTAATGCTTATATGCGCACTA
                                                                                              11270
1    Y  S  H  F  V  S  A  D  C  S  C  K  L  A  C  P  H  .  C  L  Y  A  H  Y
2    T  P  I  S  S  A  L  I  A  V  A  N  W  L  A  P  T  N  A  Y  M  R  T
3    L  P  F  R  Q  R  .  L  Q  L  Q  I  G  L  P  P  L  M  L  I  C  A  L

5'   CACATACTGATATTGGTGTCTACATTAGTATGTCACTTGTATTAGTCATTGTAGTGAAGAGATTGTACAA
                                                                                              11340
1    T  Y  .  Y  W  C  L  H  .  Y  V  T  C  I  S  H  C  S  E  E  I  V  Q
2    T  H  T  D  I  G  V  Y  I  S  M  S  L  V  L  V  I  V  V  K  R  L  Y  N
3    H  I  L  I  L  V  S  T  L  V  C  H  L  Y  .  S  L  .  R  D  C  T

5'   CCCATCACTTTCTAACTTTGCGTTAGCATTGTGCAGTGGTGTAATGTGGTTGTACACTTATAGCATTGGA
                                                                                              11410
1    P  I  T  F  .  L  C  V  S  I  V  Q  W  C  N  V  V  V  H  L  .  H  W
2    P  S  L  S  N  F  A  L  A  L  C  S  G  V  M  W  L  Y  T  S  I  G
3    T  H  H  F  L  T  L  R  .  H  C  A  V  V  .  C  G  C  T  L  I  A  L  E

5'   GAAGCCTCAAGCCCCATTGCCTATCTGGTTTTTGTCACTACACTCACTAGTGATTATACGATTACAGTCT
                                                                                              11480
1    R  S  L  K  P  H  C  L  S  G  F  C  H  Y  T  H  .  L  Y  D  Y  S  L
2    E  A  S  S  P  I  A  Y  L  V  F  V  T  T  L  T  S  D  Y  T  I  T  V
3    K  P  Q  A  P  L  P  I  W  F  L  S  L  H  S  L  V  I  I  R  L  Q  S

5'   TTGTTACTGTCAACCTTGCAAAAGTTTGCACTTATGCCATCTTTGCTTACTCACCACAGCTTACACTTGT
                                                                                              11550
1       C  Y  C  Q  P  C  K  S  L  H  L  C  H  L  C  L  L  T  T  A  Y  T  C
2    F  V  T  V  N  L  A  K  V  C  T  Y  A  L  M  P  S  L  L  T  H  H  S  L  H  L
3    L  L  L  S  T  L  Q  K  F  A  L  M  P  S  L  L  T  H  H  S  L  H  L

5'   GTTTCCGGAAGTGAAGATGATACTTTTATTATACACATGTTTAGGTTTCATGTGTACTTGCTATTTTGGT
                                                                                              11620
1    V  S  G  S  E  D  D  T  F  I  I  H  M  F  R  F  H  V  Y  L  L  F  W
2    F  P  E  V  K  M  I  L  L  Y  T  C  L  G  F  M  C  T  C  Y  F  G
3    C  F  R  K  .  R  .  Y  F  Y  Y  T  H  V  .  V  S  C  V  L  A  I  L  V

5'   GTCTTCTCTCTTTTGAACCTTAAGCTTAGAGCACCTATGGGTGTCTATGACTTTAAGGTCTCAACACAAG
                                                                                              11690
1    C  L  L  S  F  E  P  .  A  .  S  T  Y  G  C  L  .  L  .  G  L  N  T  R
2    V  F  S  L  L  N  L  K  L  R  A  P  M  G  V  Y  D  F  K  V  S  T  Q
3    S  S  L  F  .  T  L  S  L  E  H  L  W  V  S  M  T  L  R  S  Q  H  K

5'   AGTTCAGATTCATGACTGCTAACAATCTAACTGCACCTAGAAATTCTTGGGAGGCTATGGCTCTGAACTT
                                                                                              11760
1    V  Q  I  H  D  C  .  Q  S  N  C  T  .  K  F  L  G  G  Y  G  S  E  L
2    E  F  R  F  M  T  A  N  N  L  T  A  P  R  N  S  W  E  A  M  A  L  N  F
3    S  S  D  S  .  L  L  T  I  .  L  H  L  E  I  L  G  R  L  W  L  .  T

5'   TAAGTTAATAGGTATTGGCGGTACACCTTGTATAAAGGTTGCTGCTATGCAGTCTAAACTTACAGATCTT
                                                                                              11830
1    .  V  N  R  Y  W  R  Y  T  L  V  K  G  C  C  Y  A  V  .  T  Y  R  S
2    K  L  I  G  I  G  G  T  P  C  I  K  V  A  A  M  Q  S  K  L  T  D  L
3    L  S  .  .  V  L  A  V  H  L  V  .  R  L  L  L  C  S  L  N  L  Q  I  L

5'   AAATGCACATCTGTGGTTCTCCTCTCTGTGCTCCAACAGTTACACTTAGAGGCTAATAGTAGGGCCTGGG
                                                                                              11900
1    .  M  H  I  C  G  S  P  L  C  A  P  T  V  T  L  R  G  .  .  G  L  G
2    K  C  T  S  V  V  L  L  S  V  L  Q  Q  L  H  L  E  A  N  S  R  A  W
3    N  A  H  L  W  F  S  S  L  C  S  N  S  Y  T  .  R  L  I  V  G  P  G
```

Fig. 15, Cont'd

Fig. 15, Cont'd

```
5'  AACATGGCCACTTGTTTTAGAATGCACTAGGGCATCCACTTCTGCCGTTAAGTTGCAAAATAATGAGATC
0   +++++|+++++|+++++|+++++|+++++|+++++|+++++|+++++|+++++|+++++|+++++|+++++|  12670
1      N  M  A  T  C  F  R  M  H  .  G  I  H  F  C  R  .  V  A  K  .  D
2     T  W  P  L  V  L  E  C  T  R  A  S  T  S  A  V  K  L  Q  N  N  E  I
3   .  H  G  H  L  F  .  N  A  L  G  H  P  L  L  P  L  S  C  K  I  M  R  S
0
5'  AAACCTTCAGGTCTAAAAACCATGGTTGTGTCTGCGGGTCAAGAGCAAACTAACTGTAATACTAGTTCCT
0   +++++|+++++|+++++|+++++|+++++|+++++|+++++|+++++|+++++|+++++|+++++|+++++|  12740
1      Q  T  F  R  S  K  N  H  G  C  V  C  G  S  R  A  N  .  L  .  Y  .  F  L
2     K  P  S  G  L  K  T  M  V  V  S  A  G  Q  E  Q  T  N  C  N  T  S  S
3     N  L  Q  V  .  K  P  W  L  C  L  R  V  K  S  L  T  V  I  L  V  P
0
5'  TAGCTTATTACGAACCTGTGCAGGGTCGTAAAATGCTGATGGCTCTTCTTTCTGATAATGCCTATCTCAA
0   +++++|+++++|+++++|+++++|+++++|+++++|+++++|+++++|+++++|+++++|+++++|+++++|  12810
1      S  L  L  R  T  C  A  G  S  .  N  A  D  G  S  S  F  .  C  L  S  Q
2     L  A  Y  Y  E  P  V  Q  G  R  K  M  L  M  A  L  L  S  D  N  A  Y  L  K
3     .  L  I  T  N  L  C  R  V  V  K  C  .  W  L  F  F  L  I  M  P  I  S
0
5'  ATGGGCGCGTGTTGAAGGTAAGGACGGATTTGTCAGTGTAGAGCTACAACCTCCTTGCAAATTCTTGATT
0   +++++|+++++|+++++|+++++|+++++|+++++|+++++|+++++|+++++|+++++|+++++|+++++|  12880
1      M  G  A  C  .  R  .  G  R  I  C  Q  C  R  A  T  T  S  L  Q  I  L  D
2     W  A  R  V  E  G  K  D  G  F  V  S  V  E  L  Q  P  P  C  K  F  L  I
3   N  G  R  V  L  K  V  R  T  D  L  S  V  .  S  Y  N  L  L  A  N  S  .  L
0
5'  GCGGGACCAAAAGGACCTGAAATCCGATATCTCTATTTTGTTAAAAATCTTAACAACCTTCATCGCGGGC
0   +++++|+++++|+++++|+++++|+++++|+++++|+++++|+++++|+++++|+++++|+++++|+++++|  12950
1      C  G  T  K  R  T  .  N  P  I  S  L  F  C  .  K  S  .  Q  P  S  S  R  A
2     A  G  P  K  G  P  E  I  R  Y  L  Y  F  V  K  N  L  N  N  L  H  R  G
3     R  D  Q  K  D  L  K  S  D  I  S  I  L  L  K  I  L  T  T  F  I  A  G
0
5'  AAGTGTTAGGGCACATTGCTGCGACTGTTAGATTGCAAGCTGGTTCTAACACCGAGTTTGCCTCTAATTC
0   +++++|+++++|+++++|+++++|+++++|+++++|+++++|+++++|+++++|+++++|+++++|+++++|  13020
1      S  V  R  A  H  C  C  D  C  .  I  A  S  W  F  .  H  R  V  C  L  .  F
2     Q  V  L  G  H  I  A  A  T  V  R  L  Q  A  G  S  N  T  E  F  A  S  N  S
3     K  C  .  G  T  L  L  R  L  L  D  C  K  L  V  L  T  P  S  L  P  L  I
0
5'  CTCGGTGTTGTCACTTGTTAACTTCACCGTTGATCCTCAAAAAGCTTATCTCGATTTCGTCAATGCGGGA
0   +++++|+++++|+++++|+++++|+++++|+++++|+++++|+++++|+++++|+++++|+++++|+++++|  13090
1      L  G  V  V  T  C  .  L  H  R  .  S  S  K  S  L  S  R  F  R  Q  C  G
2     S  V  L  S  L  V  N  F  T  V  D  P  Q  K  A  Y  L  D  F  V  N  A  G
3     P  R  C  C  H  L  L  T  S  P  L  I  L  K  K  L  I  S  I  S  S  M  R  E
0
5'  GGTGCCCCATTGACAAATTGTGTTAAGATGCTTACTCCTAAAACTGGTACAGGTATAGCTATATCTGTTA
0   +++++|+++++|+++++|+++++|+++++|+++++|+++++|+++++|+++++|+++++|+++++|+++++|  13160
1      R  C  P  I  D  K  L  C  .  D  A  Y  S  .  N  W  Y  R  Y  S  V  I  C  .
2     G  A  P  L  T  N  C  V  K  M  L  T  P  K  T  G  T  G  I  A  I  S  V
3     V  P  H  .  Q  I  V  L  R  C  L  L  L  K  L  V  Q  V  .  L  Y  L  L
0
5'  AACCAGAGAGTACAGCTGATCAAGAGACTTATGGTGGAGCTTCAGTGTGTCTCTATTGCCGTGCGCATAT
0   +++++|+++++|+++++|+++++|+++++|+++++|+++++|+++++|+++++|+++++|+++++|+++++|  13230
1      T  R  E  Y  S  .  S  R  D  L  W  W  S  F  S  V  V  S  L  L  P  C  A  Y
2     K  P  E  S  T  A  D  Q  E  T  Y  G  G  A  S  V  C  L  Y  C  R  A  H  I
3     N  Q  R  V  Q  L  I  K  R  L  M  V  E  L  Q  C  V  S  I  A  V  R  I
0
5'  AGAACATCCTGATGTCTCTGGTGTTTGTAAAATATAAGGGTAAGTTTGTCCAAATCCCTGCTCAGTGTGTC
0   +++++|+++++|+++++|+++++|+++++|+++++|+++++|+++++|+++++|+++++|+++++|+++++|  13300
1      R  T  S  .  C  L  W  C  L  .  I  .  G  .  V  C  P  N  P  C  S  V  C
2     E  H  P  D  V  S  G  V  C  K  Y  K  G  K  F  V  Q  I  P  A  Q  C  V
3     .  N  I  L  M  S  L  V  F  V  N  I  R  V  S  L  S  K  S  L  L  S  V  S
0
```

Fig. 15, Cont'd

```
5'  CGTGACCCTGTGGGATTTTGTTTGTCAAATACCCCCTGTAATGTCTGTCAATATTGGATTGGATATGGGT
                                                                              13370
1       P   P   C   G   L   F   V   K   Y   P   L       C   L   S   L   D   W   L   W   V
2     R   D   P   V   G   F   C   L   S   N   T   P   C   N   V   C   Q   Y   W   L   G   Y   G
3       V   T   L   W   D   F   V   C   Q   L   P   P   V   M   S   V   N   L   G   L   D   M   G

5'  GCAATTGTGACTCGCTTAGGCAAGCAGCACTGCCCCAATCTAAAGATTCCAATTTTTTAAACGAGTCCGG
                                                                              13440
1       Q   L   L   A       A   S   S   T   A   P   L       R   F   Q   F   F   K   R   V   R
2     C   N   C   D   S   L   R   Q   A   A   L   P   Q   S   K   D   S   N   F   L   N   E   S   G
3       A   L   V   T   R   L   G   K   Q   H   C   P   N   L   K   L   P   L   F       T   S   P

5'  GGTTCTATTGTAAATGCCCGAATAGAACCCTGTTCAAGTGGTTTGTCCACTGATGTCGTCTTTAGGGCAT
                                                                              13510
1       G   S   L   V   N   A   R   L   E   P   C   S   S   G   L   S   T   D   V   V   F   R   A
2       V   L   L       M   P   E       N   P   V   Q   V   V   C   P   L   M   S   S   L   G   H
3     G   F   Y   C   K   C   P   N   R   T   L   F   K   W   F   V   H       C   R   L       G   L

5'  TTGACATCTGCAACTATAAGGCTAAGGTTGCTGGTATTGGAAAATACTACAAGACTAATACTTGTAGGTT
                                                                              13580
1       F   D   L   C   N   Y   K   A   K   V   A   G   L   G   K   Y   Y   K   T   N   T   C   R   F
2     L   T   S   A   T   L   R   L   R   L   L   V   L   E   N   T   T   R   L       L   V   G
3           H   L   Q   L       G   C   W   Y   W   K   L   L   Q   D       Y   L       V

5'  TGTAGAATTAGATGACCAAGGGCATCATTTAGACTCCTATTTTGTCGTTAAGAGGCATACTATGGAGAAT
                                                                              13650
1       V   E   L   D   D   Q   G   H   H   L   D   S   Y   F   V   V   K   R   H   T   M   E   N
2     L   N       M   T   K   G   L   L       T   P   L   L   S   L   R   G   L   L   W   R   L
3       C   R   L   R       P   R   A   S   F   R   L   L   F   C   R       E   A   Y   Y   G   E

5'  TATGAACTAGAGAAGCACTGTTACGACTTGTTACGTGACTGTGATGCTGTAGCTCCCCATGATTTCTTCA
                                                                              13720
1       Y   E   L   E   K   H   C   Y   D   L   L   R   D   C   D   A   V   A   P   H   D   F   F
2         M   N       R   S   T   V   T   T   C   Y   V   T   V   M   L       L   P   M   L   S   S
3     L       T   R   E   A   L   L   R   L   V   T       L       C   C   S   P       F   L   H

5'  TCTTTGATGTAGACAAAGTTAAAACACCTCATATTGTACGTCAGCGTTTAACTGAGTACACTATGATGGA
                                                                              13790
1       L   F   D   V   D   K   V   K   T   P   H   L   V   R   Q   R   L   T   E   Y   T   M   M   D
2     S   L   M       T   K   L   K   H   L   L   Y   S   V       L   S   T   L       W
3       L       C   R   Q   S       N   T   S   Y   C   T   S   A   F   N       V   H   Y   D   G

5'  TCTTGTATATGCCCTGAGGCACTTTGATCAAAATAGCGAAGTGCTTAAGGCTATCTTAGTGAAGTATGGT
                                                                              13860
1       L   V   Y   A   L   R   H   F   D   Q   N   S   E   V   L   K   A   L   L   V   K   Y   G
2     L   L   Y   M   P       G   T   L   L   K   L   A   K   C   L   R   L   S       S   M   V
3       S   C   L   C   P   E   A   L       S   K       R   S   A       G   Y   L   S   E   V   W

5'  TGCTGTGATGTTACCTACTTTGAAAATAAACTCTGGTTTGATTTTGTTGAAAATCCCAGTGTTATTGGTG
                                                                              13930
1       C   C   D   V   T   Y   F   E   N   K   L   W   F   D   F   V   E   N   P   S   V   L   G
2         A   V   M   L   P   T   L   K   L   N   S   G   L   L   L   K   L   P   V   L   L   V
3     L   L       C   Y   L   L   K       T   L   V       F   C       K   S   Q   C   Y   W   C

5'  TTTATCATAAACTTGGAGAACGTGTACGCCAAGCTATCTTAAACACTGTTAAATTTTGTGACCACATGGT
                                                                              14000
1       V   Y   H   K   L   G   E   R   V   R   Q   A   L   L   N   T   V   K   F   C   D   H   M   V
2     F   L   L   N   L   E   N   V   Y   A   K   L   S       T   L   L   N   F   V   T   T   W
3       L   S       T   W   R   T   C   T   P   S   Y   L   K   H   C       L   L       P   H   G
```

Fig. 15, Cont'd

Fig. 15, Cont'd

```
5'  GAGGGCTCTTCAGTGACGCTCAAACATTTTTCTTTGCTCAAGATGGTAATGCTGCTATTACAGATTATA
o   +---+---+---+---+---+---+---+---+---+---+---+---+---+---+---+---+---+---+---+---+  14770
1     E  G  S  S  V  T  L  K  H  F  F  F  A  Q  D  G  N  A  A  I  T  D  Y
2     R  A  L  Q  .  R  S  N  I  F  S  L  L  K  M  V  M  L  L  L  Q  I
3   G  G  L  F  S  D  A  Q  T  F  F  L  C  S  R  W  .  C  C  Y  Y  R  L  .
o
5'  ATTACTATTCTTATAATCTGCCTACTATGTGTGACATCAAACAAATGTTGTTCTGCATGGAAGTTGTAAA
o   +---+---+---+---+---+---+---+---+---+---+---+---+---+---+---+---+---+---+---+---+  14840
1     N  Y  Y  S  V  N  L  P  T  M  C  D  I  K  Q  M  L  F  C  M  E  V  V  N
2     I  T  I  L  I  I  C  L  L  C  V  T  S  N  K  C  C  S  A  W  K  L  .
3     L  L  F  L  .  S  A  Y  Y  V  .  H  Q  T  N  V  V  L  H  G  S  C  K
o
5'  CAAGTACTTCGAAATCTATGACGGTGGTTGTCTTAATGCTTCTGAAGTGGTTGTTAATAATTTAGACAAG
o   +---+---+---+---+---+---+---+---+---+---+---+---+---+---+---+---+---+---+---+---+  14910
1     K  Y  F  E  I  Y  D  G  G  C  L  N  A  S  E  V  V  V  N  N  L  D  K
2     T  S  T  S  K  S  M  T  V  V  V  L  M  L  L  K  W  L  L  I  .  T  R
3   Q  V  L  R  N  L  .  R  W  L  S  .  C  F  .  S  G  C  .  F  R  Q
o
5'  AGTGCTGGCCATCCTTTTAATAAGTTTGGCAAAGCTCGTGTCTATTATGAGAGCATGTCTTACCAGGAGC
o   +---+---+---+---+---+---+---+---+---+---+---+---+---+---+---+---+---+---+---+---+  14980
1     S  A  G  H  P  F  N  K  F  G  K  A  R  V  Y  Y  E  S  M  S  Y  Q  E
2     V  L  A  I  L  L  I  S  L  A  K  L  V  S  L  L  .  M  R  A  C  L  T  R  S
3   E  C  W  P  S  F  .  .  V  W  Q  S  S  C  L  L  .  E  H  V  L  P  G  A
o
5'  AAGATGAACTTTTTGCCATGACAAAGCGTAACGTCATTCCTACCATGACTCAAATGAATCTAAAATATGC
o   +---+---+---+---+---+---+---+---+---+---+---+---+---+---+---+---+---+---+---+---+  15050
1     Q  D  E  L  F  A  M  T  K  R  N  V  I  P  T  M  T  Q  M  N  L  K  Y  A
2     K  M  N  F  L  P  .  Q  S  V  T  S  F  L  P  .  L  K  .  I  .  N  M
3   R  .  T  F  C  H  D  K  A  .  R  H  S  Y  H  D  S  N  E  S  K  I  C
o
5'  TATTAGTGCTAAGAATAGAGCTCGCACTGTTGCAGGCGTGTCCATACTTAGCACAATGACTAATCGCCAG
o   +---+---+---+---+---+---+---+---+---+---+---+---+---+---+---+---+---+---+---+---+  15120
1     I  S  A  K  N  R  A  R  T  V  A  G  V  S  I  L  S  T  M  T  N  R  Q
2     L  L  V  L  R  I  E  L  A  L  L  Q  A  C  P  Y  L  A  Q  .  L  I  A  S
3   Y  .  C  .  E  .  S  S  H  C  C  R  R  V  H  T  .  H  N  D  .  S  P
o
5'  TACCATCAGAAAATGCTTAAGTCCATGGCTGCAACTCGTGGAGCGACTTGCGTCATTGGTACTACAAAGT
o   +---+---+---+---+---+---+---+---+---+---+---+---+---+---+---+---+---+---+---+---+  15190
1     Y  H  Q  K  M  L  K  S  M  A  A  T  R  G  A  T  C  V  I  G  T  T  K
2     T  I  R  K  C  L  S  P  W  L  Q  L  V  E  R  L  A  S  L  V  L  Q  S
3   V  P  S  E  N  A  .  V  H  G  C  N  S  W  S  D  L  R  H  W  Y  Y  K  V
o
5'  TCTACGGTGGCTGGGATTTCATGCTTAAAACATTGTACAAAGATGTTGATAATCCGCATCTTATGGGTTG
o   +---+---+---+---+---+---+---+---+---+---+---+---+---+---+---+---+---+---+---+---+  15260
1     F  Y  G  G  W  D  F  M  L  K  T  L  Y  K  D  V  D  N  P  H  L  M  G  W
2     S  T  V  A  G  I  S  C  L  K  H  C  T  K  M  L  I  I  R  I  L  W  V
3   L  R  W  L  G  F  H  A  .  N  I  V  Q  R  C  .  .  S  A  S  Y  G  L
o
5'  GGATTACCCTAAGTGTGATAGAGCTATGCCTAATATGTGTAGAATCTTCGCTTCACTCATATTAGCTCGT
o   +---+---+---+---+---+---+---+---+---+---+---+---+---+---+---+---+---+---+---+---+  15330
1     D  Y  P  K  C  D  R  A  M  P  N  M  C  R  I  F  A  S  L  I  L  A  R
2     G  I  T  L  S  V  I  E  L  C  L  .  C  V  E  S  S  L  H  S  Y  .  L  V
3   G  L  P  .  V  .  .  S  Y  A  .  Y  V  .  N  L  R  F  T  H  I  S  S
o
5'  AAACATGGCACTTGTTGTACTACAAGGGACAGATTTTATCGCTTGGCAAATGAGTGTGCTCAGGTGCTAA
o   +---+---+---+---+---+---+---+---+---+---+---+---+---+---+---+---+---+---+---+---+  15400
1     K  H  G  T  C  C  T  T  R  D  R  F  Y  R  L  A  N  E  C  A  Q  V  L
2     N  M  A  L  V  V  L  Q  G  T  D  F  I  A  W  Q  M  S  V  L  R  C  .
3   .  T  W  H  L  L  Y  Y  K  G  Q  I  L  S  L  G  K  .  V  C  S  G  A  K
o
```

```
5'   GCGAATATGTTCTATGTGGTGGTGGTTACTACGTCAAACCTGGAGGTACCAGTAGCGGAGATGCCACCAC
0    ++++++++++++++++++++++++++++++++++++++++++++++++++++++++++++++++++++  15470
1     S  E  Y  V  L  C  G  G  G  Y  Y  V  K  P  G  G  T  S  S  G  D  A  T  T
2      A  N  M  F  Y  V  V  V  V  T  T  S  N  L  E  V  P  V  A  E  M  P  P
3       R  I  C  S  M  W  W  W  L  L  R  Q  T  W  R  Y  Q  .  R  R  C  H  H

5'   TGCATATGCCAATAGTGTCTTTAACATTTTGCAGGCGACAACTGCTAATGTCAGTGCACTTATGGGTGCT
0    ++++++++++++++++++++++++++++++++++++++++++++++++++++++++++++++++++++  15540
1     A  Y  A  N  S  V  F  N  I  L  Q  A  T  T  A  N  V  S  A  L  M  G  A
2      L  H  M  P  I  V  S  L  T  F  C  R  R  Q  L  M  S  V  H  L  W  V  L
3       C  I  C  Q  .  C  L  .  H  F  A  G  D  N  C  .  C  Q  C  T  Y  G  C

5'   AATGGCAACAAGATTGTTGACAAAGAAGTTAAAGACATGCAGTTTGATTTGTATGTCAATGTTTACAGGA
0    ++++++++++++++++++++++++++++++++++++++++++++++++++++++++++++++++++++  15610
1     N  G  N  K  I  V  D  K  E  V  K  D  M  Q  F  D  L  Y  V  N  V  Y  R
2      M  A  T  R  L  L  T  K  K  L  K  T  C  S  L  I  C  M  S  M  F  T  G
3       .  W  Q  Q  D  C  .  Q  R  S  .  R  H  A  V  .  F  V  C  Q  C  L  Q  E

5'   GCACTAGCCCAGACCCCAAATTTGTTGATAAATACTATGCTTTTCTTAATAAGCACTTTTCTATGATGAT
0    ++++++++++++++++++++++++++++++++++++++++++++++++++++++++++++++++++++  15680
1     S  T  S  P  D  P  K  F  V  D  K  Y  Y  A  F  L  N  K  H  F  S  M  M  I
2      A  L  A  Q  T  P  N  L  L  I  N  T  M  L  F  L  I  S  T  F  L  .  .
3       H  .  P  R  P  Q  I  C  .  I  L  C  F  S  .  A  L  F  Y  D  D

5'   ACTGTCTGATGACGGTGTCGTTTGCTATAATAGTGATTATGCAGCTAAGGGTTACATTGCTGGAATACAG
0    ++++++++++++++++++++++++++++++++++++++++++++++++++++++++++++++++++++  15750
1     L  S  D  D  G  V  V  C  Y  N  S  D  Y  A  A  K  G  Y  I  A  G  I  Q
2      Y  C  L  M  T  V  S  F  A  I  I  V  I  M  Q  L  R  V  T  L  L  E  Y  R
3       T  V  .  R  C  R  L  L  .  L  C  S  .  G  L  H  C  W  N  T

5'   AATTTTAAGGAAACGCTGTATTATCAGAACAATGTCTTTATGTCTGAAGCTAAATGCTGGGTGGAAACCG
0    ++++++++++++++++++++++++++++++++++++++++++++++++++++++++++++++++++++  15820
1     N  F  K  E  T  L  Y  Y  Q  N  N  V  F  M  S  E  A  K  C  W  V  E  T
2      I  L  R  K  R  C  I  I  R  T  M  S  L  C  L  K  L  N  A  G  W  K  P
3       E  F  .  G  N  A  V  L  S  E  Q  C  L  Y  V  .  S  .  M  L  G  G  N  R

5'   ATCTGAAGAAAGGGCCACATGAATTCTGTTCACAGCATACGCTTTATATTAAGGATGGCGACGATGGTTA
0    ++++++++++++++++++++++++++++++++++++++++++++++++++++++++++++++++++++  15890
1     D  L  K  K  G  P  H  E  F  C  S  Q  H  T  L  Y  I  K  D  G  D  D  G  Y
2      I  .  R  K  G  H  M  N  S  V  H  S  I  R  F  I  L  R  M  A  T  M  V
3       S  E  E  R  A  T  .  I  L  F  T  A  Y  A  L  Y  .  G  W  R  R  W  L

5'   CTTCCTTCCTTATCCAGACCCTTCAAGAATTTTGTCTGCCGGTTGCTTTGTAGATGATATCGTTAAGACT
0    ++++++++++++++++++++++++++++++++++++++++++++++++++++++++++++++++++++  15960
1     F  L  P  Y  P  D  P  S  R  I  L  S  A  G  C  F  V  D  D  I  V  K  T
2      T  S  F  L  I  Q  T  L  Q  E  F  C  L  P  V  A  L  .  M  I  S  L  R  L
3       L  P  S  L  S  R  P  F  K  N  F  V  C  R  L  L  C  .  Y  R  D

5'   GACGGTACACTCATGGTAGAGCGGTTTGTGTCTTTGGCTATAGATGCTTACCCTCTCACAAAGCATGAAG
0    ++++++++++++++++++++++++++++++++++++++++++++++++++++++++++++++++++++  16030
1     D  G  T  L  M  V  E  R  F  V  S  L  A  I  D  A  Y  P  L  T  K  H  E
2      T  V  H  S  W  .  S  G  L  C  L  W  L  .  M  L  T  L  S  Q  S  M  K
3       R  Y  T  H  G  R  A  V  C  V  F  G  Y  R  C  L  P  S  H  K  A  R

5'   ATATAGAATACCAGAATGTATTCTGGGTCTACTTACAGTATATAGAAAAACTGTATAAAGACCTTACAGG
0    ++++++++++++++++++++++++++++++++++++++++++++++++++++++++++++++++++++  16100
1     D  I  E  Y  Q  N  V  F  W  V  Y  L  Q  Y  I  E  K  L  Y  K  D  L  T  G
2      I  .  N  T  R  M  Y  S  G  S  T  Y  S  I  .  K  N  C  I  K  T  L  Q
3       Y  R  I  P  E  C  I  L  G  L  L  T  V  Y  R  K  T  V  .  R  P  Y  R
```

Fig. 15, Cont'd

```
5'  ACACATGCTTGACAGTTATTCTGTCATGCTATGTGGTGATAATTCTGCTAAGTTTTGGGAAGAGGCATTC
o   +---+---+---+---+---+---+---+---+---+---+---+---+---+---+---+---+---+---+---+---+  16170
1       H   M   L   D   S   Y   S   V   M   L   C   G   D   N   S   A   K   F   W   E   E   A   F
2     D   T   C   L   T   V   I   L   S   C   Y   V   V   I   L   L   S   F   G   K   R   H   S
3       T   H   A   .   L   F   C   H   A   M   W   .   .   F   C   .   V   L   G   R   G   I
o

5'  TATAGAGATCTCTATAGTTCGCCTACCACTTTGCAGGCTGTCGGTTCATGCGTTGTATGCCATTCACAGA
o   +---+---+---+---+---+---+---+---+---+---+---+---+---+---+---+---+---+---+---+---+  16240
1       Y   R   D   L   Y   S   S   P   T   T   L   Q   A   V   G   S   C   V   V   C   H   S   Q
2     I   E   I   S   I   V   R   L   P   L   C   R   L   S   V   H   A   L   Y   A   I   H   R
3       L   .   R   S   L   .   F   A   Y   H   F   A   G   C   R   F   M   R   C   M   P   F   T   D
o

5'  CTTCCCTACGCTGTGGGACATGCATCCGTAGACCATTTCTCTGCTGTAAATGCTGCTATGATCATGTTAT
o   +---+---+---+---+---+---+---+---+---+---+---+---+---+---+---+---+---+---+---+---+  16310
1       T   S   L   R   C   G   T   C   I   R   R   P   F   L   C   C   K   C   C   Y   D   H   V   I
2     L   P   Y   A   V   G   H   A   S   V   D   H   F   S   A   V   N   A   A   M   I   M   L
3       F   P   T   L   W   D   M   H   P   .   T   I   S   L   L   .   M   L   L   .   S   C   Y
o

5'  AGCAACTCCACATAAGATGGTTTTGTCTGTTTCTCCTTACGTTTGTAATGCCCCTGGTTGTGGCGTTTCA
o   +---+---+---+---+---+---+---+---+---+---+---+---+---+---+---+---+---+---+---+---+  16380
1       A   T   P   H   K   M   V   L   S   V   S   P   Y   V   C   N   A   P   G   C   G   V   S
2     .   Q   L   H   I   R   W   C   L   F   L   L   T   F   V   M   P   L   V   V   A   F   Q
3     S   N   S   T   .   D   G   F   V   C   F   S   L   R   L   .   C   P   W   L   W   R   F
o

5'  GACGTTACTAAGCTATATTTAGGTGGTATGAGCTACTTTTGTGTAGATCATAGACCTGTGTGTAGTTTTC
o   +---+---+---+---+---+---+---+---+---+---+---+---+---+---+---+---+---+---+---+---+  16450
1       D   V   T   K   L   Y   L   G   G   M   S   Y   F   C   V   D   H   R   P   V   C   S   F
2       T   L   L   S   Y   I   .   V   V   .   A   T   F   V   .   I   I   D   L   C   V   V   F
3     R   R   Y   .   A   I   F   R   W   Y   E   L   L   C   R   S   .   T   C   V   .   F   S
o

5'  CACTTTGCGCTAATGGTCTTGTATTCGGCTTATACAAGAATATGTGCACAGGTAGTCCTTCTATAGTTGA
o   +---+---+---+---+---+---+---+---+---+---+---+---+---+---+---+---+---+---+---+---+  16520
1       P   L   C   A   N   G   L   V   F   G   L   Y   K   N   M   C   T   G   S   P   S   I   V   E
2       H   F   A   L   M   V   L   Y   S   A   Y   T   R   I   C   A   Q   V   V   L   L   .   L
3       T   L   R   .   W   S   C   I   R   L   .   Q   E   Y   V   H   R   .   S   F   Y   S   .
o

5'  ATTTAATAGGTTGGCTACCTGTGACTGGACTGAAAGTGGTGATTACACCCTTGCCAATACTACAACAGAA
o   +---+---+---+---+---+---+---+---+---+---+---+---+---+---+---+---+---+---+---+---+  16590
1       F   N   R   L   A   T   C   D   W   T   E   S   G   D   Y   T   L   A   N   T   T   E
2     N   L   I   G   W   L   P   V   T   G   L   K   V   V   I   T   P   L   P   I   L   Q   Q   N
3     I   .   .   V   G   Y   L   .   L   D   .   K   W   .   L   H   P   C   Q   Y   Y   N   R
o

5'  CCACTCAAACTTTTTGCTGCTGAGACTTTACGTGCCACTGAAGAGGCGTCTAAGCAGTCTTATGCTATTG
o   +---+---+---+---+---+---+---+---+---+---+---+---+---+---+---+---+---+---+---+---+  16660
1       P   L   K   L   F   A   A   E   T   L   R   A   T   E   E   A   S   K   Q   S   Y   A   I
2       H   S   N   F   L   L   R   L   Y   C   P   L   K   R   R   L   S   S   L   M   L   L
3     T   T   Q   T   F   C   C   .   D   F   T   C   H   .   R   G   V   .   A   V   L   C   Y   C
o

5'  CCACCATCAAAGAAATTGTTGGTGAGCGCCAACTATTACTTGTGTGGGAGGCTGGCAAGTCCAAACCACC
o   +---+---+---+---+---+---+---+---+---+---+---+---+---+---+---+---+---+---+---+---+  16730
1       A   T   I   K   E   I   V   G   E   R   Q   L   L   L   V   W   E   A   G   K   S   K   P   P
2       P   P   S   K   K   L   L   V   S   A   N   Y   Y   L   C   G   R   L   A   S   P   N   H
3       H   H   Q   R   N   C   W   .   A   P   T   I   T   C   V   G   G   W   Q   V   Q   T   T
o

5'  ACTCAATCGTAATTATGTTTTTACTGGTTATCATATAACCAAAAATAGTAAAGTGCAGCTCGGTGAGTAC
o   +---+---+---+---+---+---+---+---+---+---+---+---+---+---+---+---+---+---+---+---+  16800
1       L   N   R   N   Y   V   F   T   G   Y   H   I   T   K   N   S   K   V   Q   L   G   E   Y
2     H   S   I   V   I   M   F   L   L   V   I   I   .   P   K   I   V   K   C   S   S   V   S   T
3       T   Q   S   .   L   C   F   Y   W   L   S   Y   N   Q   K   .   .   S   A   A   R   .   V
o
```

Fig. 15, Cont'd

```
5'   ATTTTCGAGCGCATTGATTATAGTGATGCTGTATCCTACAAGTCTAGTACAACGTATAAACTGACTGTAG
o    +----+----+----+----+----+----+----+----+----+----+----+----+----+----+   16870
1      I  F  E  R  I  D  Y  S  D  A  V  S  Y  K  S  S  T  T  Y  K  L  T  V
2     F  S  S  A  L  I  I  V  M  L  Y  P  T  S  L  V  Q  R  I  N  .  L
3    H  F  R  A  H  .  L  .  .  C  C  I  L  Q  V  .  Y  N  V  .  T  D  C  R
o

5'   GTGACATCTTCGTACTTACCTCTCACTCTGTGGCTACCTTGACGGCGCCCACAATTGTGAATCAAGAGAG
o    +----+----+----+----+----+----+----+----+----+----+----+----+----+----+   16940
1      G  D  I  F  V  L  T  S  H  S  V  A  T  L  T  A  P  T  I  V  N  Q  E  R
2     V  T  S  S  Y  L  P  L  T  L  W  L  P  .  R  R  P  Q  L  .  I  K  R
3    .  H  L  R  T  Y  L  S  L  C  G  Y  L  D  G  A  H  N  C  E  S  R  E
o

5'   GTATGTTAAAATTACTGGGTTGTACCCAACCATTACGGTACCTGAAGAGTTCGCAAGTCATGTTGCCAAC
o    +----+----+----+----+----+----+----+----+----+----+----+----+----+----+   17010
1      Y  V  K  I  T  G  L  Y  P  T  I  T  V  P  E  E  F  A  S  H  V  A  N
2     G  M  L  K  L  L  G  C  T  Q  P  L  R  Y  L  K  S  S  Q  V  M  L  P  T
3    V  C  .  N  Y  W  V  V  P  N  H  Y  G  T  .  R  V  R  K  S  C  C  Q
o

5'   TTCCAAAAATCAGGTTATAGTAAATATGTCACTGTTCAGGGACCACCTGGCACTGGCAAAAGTCATTTTG
o    +----+----+----+----+----+----+----+----+----+----+----+----+----+----+   17080
1      F  Q  K  S  G  Y  S  K  Y  V  T  V  Q  G  P  P  G  T  G  K  S  H  F
2     S  K  N  Q  V  I  V  N  M  S  L  F  R  D  H  L  A  L  A  K  V  I  L
3    L  P  K  I  R  L  .  .  I  C  H  C  S  G  T  T  W  H  W  Q  K  S  F  C
o

5'   CTATAGGGTTAGCGATTTACTACCCTACAGCACGTGTTGTTTATACAGCATGTTCACACGCAGCTGTTGA
o    +----+----+----+----+----+----+----+----+----+----+----+----+----+----+   17150
1      A  I  G  L  A  I  Y  Y  P  T  A  R  V  V  Y  T  A  C  S  H  A  A  V  D
2     L  .  G  .  R  F  T  T  L  Q  H  V  L  F  I  Q  H  V  H  T  Q  L  L
3    Y  R  V  S  D  L  L  P  Y  S  T  C  C  L  Y  S  M  F  T  R  S  C  .
o

5'   TGCTTTGTGTGAAAAAGCTTTTAAATATTTGAACATTGCTAAATGTTCCCGTATCATTCCTGCAAAGGCA
o    +----+----+----+----+----+----+----+----+----+----+----+----+----+----+   17220
1      A  L  C  E  K  A  F  K  Y  L  N  I  A  K  C  S  R  I  I  P  A  K  A
2     M  L  C  V  K  K  L  L  N  .  I  .  T  L  N  V  P  V  S  F  L  Q  R  H
3    C  F  V  .  K  S  F  .  I  F  E  H  C  .  M  F  P  Y  H  S  C  K  G
o

5'   CGTGTTGAGTGCTATGACAGGTTTAAAGTTAATGAGACAAATTCTCAATATTTGTTTAGTACTATTAATG
o    +----+----+----+----+----+----+----+----+----+----+----+----+----+----+   17290
1      R  V  E  C  Y  D  R  F  K  V  N  E  T  N  S  Q  Y  L  F  S  T  I  N
2     V  L  S  A  M  T  G  L  K  L  M  R  Q  I  L  N  I  C  L  V  L  L  M
3    T  C  .  V  L  .  Q  V  .  S  .  .  D  K  F  S  I  F  V  .  Y  Y  .  C
o

5'   CTCTACCAGAAACTTCTGCCGATATTCTGGTGGTTGATGAGGTTAGTATGTGCACTAATTATGATCTTTC
o    +----+----+----+----+----+----+----+----+----+----+----+----+----+----+   17360
1      A  L  P  E  T  S  A  D  I  L  V  V  D  E  V  S  M  C  T  N  Y  D  L  S
2     L  Y  Q  K  L  L  P  I  F  W  W  L  M  R  L  V  C  A  L  I  M  I  F
3    S  T  R  N  F  C  R  Y  S  G  G  .  .  G  .  Y  V  H  .  L  .  S  F
o

5'   AATTATTAATGCACGTATTAAAGCTAAGCACATTGTCTATGTAGGAGATCCAGCACAGTTGCCAGCTCCT
o    +----+----+----+----+----+----+----+----+----+----+----+----+----+----+   17430
1      I  I  N  A  R  I  K  A  K  H  I  V  Y  V  G  D  P  A  Q  L  P  A  P
2     Q  L  L  M  H  V  L  K  L  S  T  L  S  M  .  E  I  Q  H  S  C  L
3    N  Y  .  C  T  Y  .  S  .  A  H  C  L  C  R  R  S  S  T  V  A  S  S
o

5'   AGGACTTTGTTGACTAGAGGCACATTGGAACCAGAAAATTTCAATAGTGTCACTAGATTGATGTGTAACT
o    +----+----+----+----+----+----+----+----+----+----+----+----+----+----+   17500
1      R  T  L  L  T  R  G  T  L  E  P  E  N  F  N  S  V  T  R  L  M  C  N
2     G  L  C  .  L  E  A  H  W  N  Q  K  I  S  I  V  S  L  D  .  C  V  T
3    .  D  F  V  D  .  R  H  I  G  T  R  K  F  Q  .  C  H  .  I  D  V  .  L
o
```

Fig. 15, Cont'd

```
5'  TAGGTCCTGACATATTTTTAAGTATGTGCTACAGGTGTCCTAAGGAAATAGTAAGCACTGTGAGCGCTCT
o   +----+----+----+----+----+----+----+----+----+----+----+----+----+----+  17570
1     L  G  P  D  I  F  L  S  M  C  Y  R  C  P  K  E  I  V  S  T  V  S  A  L
2        V  L  T  Y  F  .  V  C  A  T  G  V  L  R  K  .  .  A  L  .  A  L
3     R  S  .  H  I  F  K  Y  V  L  Q  V  S  .  G  N  S  K  H  C  E  R  S

5'  TGTCTACAATAATAAATTGTTAGCCAAGAAGGAGCTTTCAGGCCAGTGCTTTAAAATACTCTATAAGGGC
o   +----+----+----+----+----+----+----+----+----+----+----+----+----+----+  17640
1     V  Y  N  N  K  L  L  A  K  K  E  L  S  G  Q  C  F  K  I  L  Y  K  G
2     L  S  T  I  .  N  C  .  P  R  R  S  F  Q  A  S  A  L  K  Y  S  I  R  A
3     C  L  Q  .  .  I  V  S  Q  E  G  A  F  R  P  V  L  .  N  T  L  .  G

5'  AATGTGACGCATGATGCTAGCTCTGCCATTAATAGACCACAACTCACATTTGTGAAGAATTTTATTACTG
o   +----+----+----+----+----+----+----+----+----+----+----+----+----+----+  17710
1     N  V  T  H  D  A  S  S  A  I  N  R  P  Q  L  T  F  V  K  N  F  I  T
2     M  .  R  M  M  L  A  L  P  L  I  D  H  N  S  H  L  .  R  I  L  L
3     Q  C  D  A  .  C  .  L  C  H  .  .  T  T  T  H  I  C  E  E  F  Y  Y  C

5'  CCAATCCGGCATGGAGTAAGGCAGTCTTTATTTCGCCTTACAATTCACAGAATGCTGTGTCTCGTTCAAT
o   +----+----+----+----+----+----+----+----+----+----+----+----+----+----+  17780
1     A  N  P  A  W  S  K  A  V  F  I  S  P  Y  N  S  Q  N  A  V  S  R  S  M
2     P  I  R  H  G  V  R  Q  S  L  F  R  L  T  I  H  R  M  L  C  L  V  Q
3     Q  S  G  M  E  .  G  S  L  Y  F  A  L  Q  F  T  E  C  C  V  S  F  N

5'  GCTGGGTCTTACCACTCAGACTGTTGATTCCTCACAGGGTTCAGAATACCAGTACGTTATCTTCTGTCAA
o   +----+----+----+----+----+----+----+----+----+----+----+----+----+----+  17850
1     L  G  L  T  T  Q  T  V  D  S  S  Q  G  S  E  Y  Q  Y  V  I  F  C  Q
2     C  W  V  L  P  L  R  L  L  I  P  H  R  V  Q  N  T  S  T  L  S  V  K
3     A  G  S  Y  H  S  D  .  F  L  T  G  F  R  I  P  V  R  Y  L  L  S

5'  ACAGCAGATACGGCACATGCTAACAACATTAACAGATTTAATGTTGCAATCACTCGTGCCCAAAAAGGTA
o   +----+----+----+----+----+----+----+----+----+----+----+----+----+----+  17920
1     T  A  D  T  A  H  A  N  N  I  N  R  F  N  V  A  I  T  R  A  Q  K  G
2     Q  Q  I  R  H  M  L  T  T  L  T  D  L  M  L  Q  S  L  V  P  K  K  V
3     N  S  R  Y  G  T  C  .  Q  H  .  Q  I  .  C  C  N  H  S  C  P  K  R  Y

5'  TTCTTTGTGTTATGACATCTCAGGCACTCTTTGAGTCCTTAGAGTTTACTGAATTGTCTTTTACTAATTA
o   +----+----+----+----+----+----+----+----+----+----+----+----+----+----+  17990
1     I  L  C  V  M  T  S  Q  A  L  F  E  S  L  E  F  T  E  L  S  F  T  N  Y
2     F  F  V  L  .  H  L  R  H  S  L  S  P  .  S  L  L  N  C  L  L  I
3     S  L  C  Y  D  I  S  G  T  L  .  V  L  R  V  Y  .  I  V  F  Y  .  L

5'  CAAGCTCCAGTCTCAGATTGTAACTGGCCTTTTTTAAAGATTGCTCTAGAGAAACTTCTGGCCTCTCACCT
o   +----+----+----+----+----+----+----+----+----+----+----+----+----+----+  18060
1     K  L  Q  S  Q  I  V  T  G  L  F  K  D  C  S  R  E  T  S  G  L  S  P
2     T  S  S  S  L  R  L  .  L  A  F  L  K  I  A  L  E  K  L  L  A  S  H  L
3     Q  A  P  V  S  D  C  N  W  P  F  .  R  L  L  .  R  N  F  W  P  L  T

5'  GCTTATGCACCAACATATGTTAGTGTTGATGACAAGTATAAGACGAGTGATGAGCTTTGCGTGAATCTTA
o   +----+----+----+----+----+----+----+----+----+----+----+----+----+----+  18130
1     A  Y  A  P  T  Y  V  S  V  D  D  K  Y  K  T  S  D  E  L  C  V  N  L
2     L  M  H  Q  H  M  L  V  L  M  T  S  I  R  R  V  M  S  F  A  .  I  L
3     C  L  C  T  N  I  C  .  C  .  .  Q  V  .  D  E  .  A  L  R  E  S  .

5'  ATTTACCCGCAAATGTCCCATACTCTCGTGTTATTTCCAGGATGGGCTTTAAACTCGATGCAACAGTTCC
o   +----+----+----+----+----+----+----+----+----+----+----+----+----+----+  18200
1     N  L  P  A  N  V  P  Y  S  R  V  I  S  R  M  G  F  K  L  D  A  T  V  P
2     I  Y  P  Q  M  S  H  T  L  V  L  F  P  G  W  A  L  N  S  M  Q  Q  F
3     F  T  R  K  C  P  I  L  S  C  Y  F  Q  D  G  L  .  T  R  C  N  S  S
```

Fig. 15, Cont'd

Fig. 15, Cont'd

```
5'  CATGAAAAGAAATTGAATTCCTGTTGTAGAATCGTTGAGCGCAACGTCGTACGTGCTGCTCTTCTTGCCG
o   +---+---+---+---+---+---+---+---+---+---+---+---+---+---+---+---+---+---+    18970
1       H  E  K  K  L  N  S  C  C  R  I  V  E  R  N  V  V  R  A  A  L  L  A
2     M  K  R  N  .  I  P  V  V  E  S  L  S  A  T  S  Y  V  L  L  F  L  P
3   T  .  K  E  I  E  F  L  L  .  N  R  .  A  Q  R  R  T  C  C  S  S  C  R
o
5'  GTTCATTTGACAAAGTCTATGATATTGGCAATCCTAAAGGAATTCCTATTGTTGATGACCCTGTGGTTGA
o   +---+---+---+---+---+---+---+---+---+---+---+---+---+---+---+---+---+---+    19040
1    G  S  F  D  K  V  Y  D  I  G  N  P  K  G  I  P  I  V  D  D  P  V  V  D
2     V  H  L  T  K  S  M  I  L  A  I  L  K  E  F  L  L  M  T  L  W  L
3       F  I  .  Q  S  L  .  Y  W  Q  S  .  R  N  S  Y  C  .  P  C  G  .
o
5'  TTGGCATTATTTTGATGCACAGCCCTTGACCAGGAAGGTACAACAGCTTTTCTATACAGAGGACATGGCC
o   +---+---+---+---+---+---+---+---+---+---+---+---+---+---+---+---+---+---+    19110
1    W  H  Y  F  D  A  Q  P  L  T  R  K  V  Q  Q  L  F  Y  T  E  D  M  A
2     I  G  I  I  L  M  H  S  P  .  P  G  R  Y  N  S  F  S  I  Q  R  T  W  P
3       L  A  L  F  .  C  T  A  L  D  Q  E  G  T  T  A  F  L  Y  R  G  H  G
o
5'  TCAAGATTTGCTGATGGGCTCTGCTTATTTTGGAACTGTAATGTACCAAAATATCCTAATAATGCAATTG
o   +---+---+---+---+---+---+---+---+---+---+---+---+---+---+---+---+---+---+    19180
1    S  R  F  A  D  G  L  C  L  F  W  N  C  N  V  P  K  Y  P  N  N  A  I
2     Q  D  L  L  M  G  S  A  Y  F  G  T  V  M  Y  Q  N  I  L  I  M  Q  L
3   L  K  I  C  .  W  A  L  L  I  L  E  L  .  C  T  K  I  S  .  .  C  N  C
o
5'  TATGCAGGTTTGACACACGTGTGCATTCTGAGTTCAATTTGCCAGGTTGTGATGGCGGTAGTTTGTATGT
o   +---+---+---+---+---+---+---+---+---+---+---+---+---+---+---+---+---+---+    19250
1    V  C  R  F  D  T  R  V  H  S  E  F  N  L  P  G  C  D  G  G  S  L  Y  V
2     Y  A  G  L  T  H  V  C  I  L  S  S  I  C  Q  V  V  M  A  V  V  C  M
3       M  Q  V  .  H  T  C  A  F  .  V  Q  F  A  R  L  .  W  R  .  F  V  C
o
5'  TAACAAGCACGCTTTTCATACACCAGCATATGATGTGAGTGCATTCCGTGATCTGAAACCTTTACCATTC
o   +---+---+---+---+---+---+---+---+---+---+---+---+---+---+---+---+---+---+    19320
1    N  K  H  A  F  H  T  P  A  Y  D  V  S  A  F  R  D  L  K  P  L  P  F
2     L  T  S  T  L  F  I  H  Q  H  M  M  .  V  H  S  V  I  .  N  L  Y  H  S
3       .  Q  A  R  F  S  Y  T  S  I  .  C  E  C  I  P  .  S  E  T  F  T  I
o
5'  TTTTATTATTCTACTACACCATGTGAAGTGCATGGTAATGGTAGTATGATAGAGGATATTGATTATGTAC
o   +---+---+---+---+---+---+---+---+---+---+---+---+---+---+---+---+---+---+    19390
1    F  Y  Y  S  T  T  P  C  E  V  H  G  N  G  S  M  I  E  D  I  D  Y  V
2     F  I  I  L  L  H  H  V  K  C  M  V  M  V  V  .  R  I  L  I  M  Y
3   L  L  L  F  Y  Y  T  M  .  S  A  W  .  W  .  Y  D  R  G  Y  .  L  C  T
o
5'  CCCTAAAATCTGCAGTCTGTATTACAGCTTGTAATTTAGGGGGCGCTGTTTGTAGGAAGCATGCTACAGA
o   +---+---+---+---+---+---+---+---+---+---+---+---+---+---+---+---+---+---+    19460
1    P  L  K  S  A  V  C  I  T  A  C  N  L  G  G  A  V  C  R  K  H  A  T  E
2     P  .  N  L  Q  S  V  L  Q  L  V  I  .  F  .  G  A  L  F  V  G  S  M  L  Q
3       P  K  I  C  S  L  Y  Y  S  L  .  F  R  G  R  C  L  .  E  A  C  Y  R
o
5'  GTACAGAGAGTATATGGAAGCATATAATCTTGTCTCTGCATCAGGTTTCCGCCTTTGGTGTTATAAGACC
o   +---+---+---+---+---+---+---+---+---+---+---+---+---+---+---+---+---+---+    19530
1    Y  R  E  Y  M  E  A  Y  N  L  V  S  A  S  G  F  R  L  W  C  Y  K  T
2     S  T  E  S  I  W  K  H  I  I  L  S  L  H  Q  V  S  A  F  G  V  I  R  P
3       V  Q  R  V  Y  G  S  I  .  S  C  L  C  I  R  F  P  P  L  V  L  .  D
o
5'  TTTGATATTTATAATCTCTGGTCTACTTTTACAAAAGTTCAAGGTTTGGAAAACATTGCTTTTAATGTTG
o   +---+---+---+---+---+---+---+---+---+---+---+---+---+---+---+---+---+---+    19600
1    F  D  I  Y  N  L  W  S  T  F  T  K  V  Q  G  L  E  N  I  A  F  N  V
2     L  I  F  I  S  G  L  L  L  Q  K  F  K  V  W  K  T  L  L  L  M  L
3       L  .  Y  L  .  S  L  V  Y  F  Y  K  S  S  R  F  G  K  H  C  F  .  C  C
o
```

```
5'  ATAAACTTCAACCGTTAACTTTCCTGTTGGATTTTTCTGTTGATGGTTATATACGCAGAGCTATAGACTG
o   +----+----+----+----+----+----+----+----+----+----+----+----+----+----+    22470
1       . T  S  T  V  N  F  P  V  G  F  F  C  . W  L  Y  T  Q  S  Y  R  L
2     Y K  L  Q  P  L  T  F  L  L  D  F  S  V  D  G  Y  I  R  R  A  I  D  C
3    I  N  F  N  R  . L  S  C  W  I  F  L  L  M  V  I  Y  A  E  L  . T
o
5'  TGGTTTTAATGATTTGTCACAACTCCACTGCTCATATGAATCCTTCGATGTTGAATCTGGAGTTTATTCA
o   +----+----+----+----+----+----+----+----+----+----+----+----+----+----+    22540
1     W  F  . F  V  T  T  P  L  L  I  . I  L  R  C  . I  W  S  L  F
2       G  F  N  D  L  S  Q  L  H  C  S  Y  E  S  F  D  V  E  S  G  V  Y  S
3    V  V  L  M  I  C  H  N  S  T  A  H  M  N  P  S  M  L  N  L  E  F  I  Q
o
5'  GTTCGTCTTTCGAAGCAAAACCTTCTGGCTCAGTGTGGAACAGGCTGAAGGTGTTGAATGTGATTTTT
o   +----+----+----+----+----+----+----+----+----+----+----+----+----+----+    22610
1     S  F  V  F  R  S  K  T  F  W  L  S  C  G  T  G  . R  C  . M  . F  F
2      V  S  S  F  E  A  K  P  S  G  S  V  E  Q  A  E  G  V  E  C  D  F
3        F  R  L  S  K  Q  N  L  L  A  Q  L  W  N  R  L  K  V  L  N  V  I  F
o
5'  CACCTCTTCTGTCTGGCACACCTCCTCAGGTTTATAATTTCAAGCGTTTGGTTTTTACCAATTGCAATTA
o   +----+----+----+----+----+----+----+----+----+----+----+----+----+----+    22680
1      T  S  S  V  W  H  T  S  S  G  L  . F  Q  A  F  G  F  Y  Q  L  Q  L
2     S  P  L  L  S  G  T  P  P  Q  V  Y  N  F  K  R  L  V  F  T  N  C  N  Y
3       H  L  F  C  L  A  H  L  L  R  F  I  I  S  S  V  W  F  L  P  I  A  I
o
5'  TAATCTTACCAAATTGCTTTCACTTTTTTCTGTGAATGATTTTACTTGTAGTCAAATATCTCCAGCAGCA
o   +----+----+----+----+----+----+----+----+----+----+----+----+----+----+    22750
1     . S  Y  Q  I  A  F  T  F  F  C  E  . F  Y  L  . S  N  I  S  S  S
2       N  L  T  K  L  L  S  L  F  S  V  N  D  F  T  C  S  Q  I  S  P  A  A
3    I  I  L  P  N  C  F  H  F  F  L  . M  I  L  L  V  V  K  Y  L  Q  Q  Q
o
5'  ATTGCTAGCAACTGTTATTCTTCACTGATTTTGGATTACTTTTCATACCCACTTAGTATGAAATCCGATC
o   +----+----+----+----+----+----+----+----+----+----+----+----+----+----+    22820
1     N  C  . Q  L  L  F  F  T  D  F  G  L  L  F  I  P  T  . Y  E  I  R  S
2      I  A  S  N  C  Y  S  S  L  I  L  D  Y  F  S  Y  P  L  S  M  K  S  D
3        L  L  A  T  V  I  L  H  . F  W  I  T  F  H  T  H  L  V  . N  P  I
o
5'  TCAGTGTTAGTTCTGCTGGTCCAATATCCCAGTTTAATTATAAACAGTCCTTTTCTAATCCCACATGTTT
o   +----+----+----+----+----+----+----+----+----+----+----+----+----+----+    22890
1       Q  C  . F  C  W  S  N  I  P  V  . L  . T  V  L  F  . S  H  M  F
2     L  S  V  V  S  S  A  G  P  I  S  Q  F  N  Y  K  Q  S  F  S  N  P  T  C  L
3       S  V  L  V  L  L  V  Q  Y  P  S  L  I  I  N  S  P  F  L  I  P  H  V
o
5'  GATTTTAGCGACTGTTCCTCATAACCTTACTACTATTACTAAGCCTCTTAAGTACAGCTATATTAACAAG
o   +----+----+----+----+----+----+----+----+----+----+----+----+----+----+    22960
1     D  F  S  D  C  S  S  . P  Y  Y  Y  Y  . A  S  . V  Q  L  Y  . Q
2      I  L  A  T  V  P  H  N  L  T  T  I  T  K  P  L  K  Y  S  Y  I  N  K
3       . F  . R  L  F  L  I  T  L  L  L  L  S  L  L  S  T  A  I  L  T  S
o
5'  TGCTCTCGTCTTCTTTCTGATGATCGTACTGAAGTACCTCAGTTAGTGAACGCTAATCAATACTCACCCT
o   +----+----+----+----+----+----+----+----+----+----+----+----+----+----+    23030
1     V  L  S  S  F  .      S  Y  .    S  T  S  V  S  E  R  . S  I  L  T  L
2      C  S  R  L  L  S  D  D  R  T  E  V  P  Q  L  V  N  A  N  Q  Y  S  P
3       A  L  V  F  F  L  M  I  V  L  K  Y  L  S  . T  L  I  N  T  H  P
o
5'  GTGTATCCATTGTCCCATCCACTGTGTGGGAAGACGGTGATTATTATAGGAAACAACTATCTCCACTTGA
o   +----+----+----+----+----+----+----+----+----+----+----+----+----+----+    23100
1     C  I  H  C  P  I  H  C  V  G  R  R  . L  L  . E  T  T  I  S  T  .
2      C  V  S  I  V  P  S  T  V  W  E  D  G  D  Y  Y  R  K  Q  L  S  P  L  E
3       V  Y  P  L  S  H  P  L  C  G  K  T  V  I  I  I  G  N  N  Y  L  H  L
o
```

Fig. 15, Cont'd

```
5'  AGGTGGTGGCTGGCTTGTTGCTAGTGGCTCAACTGTTGCCATGACTGAGCAATTACAGATGGGCTTTGGT
0   +----+----+----+----+----+----+----+----+----+----+----+----+----+----+    23170
1     R  W  W  L  A  C  C  .  W  L  N  C  C  H  D  .  A  I  T  D  G  L  W
2    G  G  G  W  L  V  A  S  G  S  T  V  A  M  T  E  Q  L  Q  M  G  F  G
3   K  V  V  A  G  L  L  L  V  A  Q  L  L  P  .  L  S  N  Y  R  W  A  L  V
0
5'  ATTACAGTTCAATATGGTACAGACACCAATAGTGTTTGCCCCAAGCTTGAATTTGCTAATGACACAAAAA
0   +----+----+----+----+----+----+----+----+----+----+----+----+----+----+    23240
1     Y  Y  S  S  I  W  Y  R  H  Q  .  C  L  P  Q  A  .  I  C  .  H  K  N
2    I  T  V  Q  Y  G  T  D  T  N  S  V  C  P  K  L  E  F  A  N  D  T  K
3   L  Q  F  N  M  V  Q  T  P  I  V  F  A  P  S  L  N  L  L  M  T  Q  K
0
5'  TTGCCTCTCAATTAGGCAATTGCGTGGAATATTCCCTCTATGGTGTTTCGGGCCGTGGTGTTTTTCAGAA
0   +----+----+----+----+----+----+----+----+----+----+----+----+----+----+    23310
1     C  L  S  I  R  Q  L  R  G  I  F  P  L  W  C  F  G  P  W  C  F  S  E
2    L  A  S  Q  L  G  N  C  V  E  Y  S  L  Y  G  V  S  G  R  G  V  F  Q  N
3   L  P  L  N  .  A  I  A  W  N  I  P  S  M  V  F  R  A  V  V  F  F  R
0
5'  TTGCACAGCTGTAGGTGTTCGACAGCAGCGCTTTGTTTATGATGCGTACCAGAATTTAGTTGGCTATTAT
0   +----+----+----+----+----+----+----+----+----+----+----+----+----+----+    23380
1     L  H  S  C  R  C  S  T  A  A  L  C  L  .  C  V  P  E  F  S  W  L  L
2    C  T  A  V  G  V  R  Q  Q  R  F  V  Y  D  A  Y  Q  N  L  V  G  Y  Y
3   T  A  Q  L  .  V  F  D  S  S  A  L  F  M  M  R  T  R  I  .  L  A  I  I
0
5'  TCTGATGATGGCAACTACTACTGTTTGCGTGCTTGTGTTAGTGTTCCTGTTTCTGTCATCTATGATAAAG
0   +----+----+----+----+----+----+----+----+----+----+----+----+----+----+    23450
1     F  .  .  W  Q  L  L  L  F  A  C  L  C  .  C  S  C  F  C  H  L  .  R
2    S  D  D  G  N  Y  Y  C  L  R  A  C  V  S  V  P  V  S  V  I  Y  D  K
3   L  M  M  A  T  T  T  V  C  V  L  V  L  V  F  L  F  L  S  S  M  I  K
0
5'  AAACTAAAACCCACGCTACTCTATTTGGTAGTGTTGCATGTGAACACATTTCTTCTACCATGTCTCAATA
0   +----+----+----+----+----+----+----+----+----+----+----+----+----+----+    23520
1     N  .  N  P  R  Y  S  I  W  .  C  C  M  .  T  H  F  F  Y  H  V  S  I
2    E  T  K  T  H  A  T  L  F  G  S  V  A  C  E  H  I  S  S  T  M  S  Q  Y
3   K  L  K  P  T  L  L  Y  L  V  V  L  H  V  N  T  F  L  L  P  C  L  N
0
5'  CTCCCGTTCTACGCGATCAATGCTTAAACGGCGAGATTCTACATATGGCCCCCTTCAGACACCTGTTGGT
0   +----+----+----+----+----+----+----+----+----+----+----+----+----+----+    23590
1     L  P  F  Y  A  I  N  A  .  T  A  R  F  Y  I  W  P  P  S  D  T  C  W
2    S  R  S  T  R  S  M  L  K  R  R  D  S  T  Y  G  P  L  Q  T  P  V  G
3   T  P  V  L  R  D  Q  C  L  N  G  E  I  L  H  M  A  P  F  R  H  L  L  V
0
5'  TGTGTCCTAGGACTTGTTAATTCCTCTTTGTTCGTAGAGGACTGCAAGTTGCCTCTTGGTCAATCTCTCT
0   +----+----+----+----+----+----+----+----+----+----+----+----+----+----+    23660
1     L  C  P  R  T  C  .  F  L  F  V  R  R  G  L  Q  V  A  S  W  S  I  S  L
2    C  V  L  G  L  V  N  S  S  L  F  V  E  D  C  K  L  P  L  G  Q  S  L
3   V  S  .  D  L  L  I  P  L  C  S  .  R  T  A  S  C  L  L  V  N  L  S
0
5'  GTGCTCTTCCTGACACACCTAGTACTCTCACACCTCGCAGTGTGCGCTCTGTTCCAGGTGAAATGCGCTT
0   +----+----+----+----+----+----+----+----+----+----+----+----+----+----+    23730
1     C  S  S  .  H  T  .  Y  S  H  T  S  Q  C  A  L  C  S  R  .  N  A  L
2    C  A  L  P  D  T  P  S  T  L  T  P  R  S  V  R  S  V  P  G  E  M  R  L
3   V  L  F  L  T  H  L  V  L  S  H  L  A  V  C  A  L  F  Q  V  K  C  A
0
5'  GGCATCCATTGCTTTTAATCATCCTATTCAGGTTGATCAACTTAATAGTAGTTATTTTAAATTAAGTATA
0   +----+----+----+----+----+----+----+----+----+----+----+----+----+----+    23800
1     G  I  H  C  F  .  S  S  Y  S  G  .  S  T  .  .  L  F  .  I  K  Y
2    A  S  I  A  F  N  H  P  I  Q  V  D  Q  L  N  S  S  Y  F  K  L  S  I
3   W  H  P  L  L  L  I  I  L  F  R  L  I  N  L  I  V  V  I  L  N  .  V  Y
0
```

Fig. 15, Cont'd

```
5'  CCCACTAATTTTTCCTTTGGTGTGACTCAGGAGTACATTCAGACAACCATTCAGAAAGTTACTGTTGATT
 o  +----+----+----+----+----+----+----+----+----+----+----+----+----+----+  23870
 1   T  H  .  F  F  L  W  C  D  S  G  V  H  S  D  N  H  S  E  S  Y  C  .  L
 2  P  T  N  F  S  F  G  V  T  Q  E  Y  I  Q  T  T  I  Q  K  V  T  V  D
 3    P  L  I  F  P  L  V  .  L  R  S  T  F  R  Q  P  F  R  K  L  L  L  I
 o

5' GTAAACAGTACGTTTGCAATGGTTTCCAGAAGTGTGAGCAATTACTGCGCGAGTATGGCCAGTTTTGTTC
 o  +----+----+----+----+----+----+----+----+----+----+----+----+----+----+  23940
 1   .  T  V  R  L  Q  W  F  P  E  V  .  A  I  T  A  R  V  W  P  V  L  F
 2  C  K  Q  V  V  C  N  G  F  Q  K  C  E  Q  L  L  R  E  Y  G  Q  F  C  S
 3   V  N  S  T  F  A  M  V  S  R  S  V  S  N  Y  C  A  S  M  A  S  F  V
 o

5' CAAAATAAACCAGGCTCTCCATGGTGCCAATTTACGCCAGGATGATTCTGTACGTAATTTGTTTGCGAGC
 o  +----+----+----+----+----+----+----+----+----+----+----+----+----+----+  24010
 1   Q  N  K  P  G  S  P  W  C  Q  F  T  P  G  .  F  C  T  .  F  V  C  E
 2    K  I  N  Q  A  L  H  G  A  N  L  R  Q  D  D  S  V  R  N  L  F  A  S
 3  P  K  .  T  R  L  S  M  V  P  I  Y  A  R  M  I  L  Y  V  I  C  L  R  A
 o

5' GTGAAAAGCTCTCAATCATCTCCTATCATACCAGGTTTTGGAGGTGACTTTAATTTGACACTTCTAGAAC
 o  +----+----+----+----+----+----+----+----+----+----+----+----+----+----+  24080
 1   R  E  K  L  S  I  I  S  Y  H  T  R  F  W  R  .  L  F  D  T  S  R  T
 2  V  K  S  S  Q  S  S  P  I  I  P  G  F  G  G  D  F  N  L  T  L  L  E
 3    .  K  A  L  N  H  L  L  S  Y  Q  V  L  E  V  T  L  I  .  H  F  .  N
 o

5' CTGTTTCTATATCTACTGGCAGTCGTAGTGCACGTAGTGCTATTGAGGATTTGCTATTTGACAAAGTCAC
 o  +----+----+----+----+----+----+----+----+----+----+----+----+----+----+  24150
 1   C  F  Y  I  Y  W  Q  S  .  C  T  .  C  Y  .  G  F  A  I  .  Q  S  H
 2  P  V  S  I  S  T  G  S  R  S  A  R  S  A  I  E  D  L  L  F  D  K  V  T
 3   L  F  L  Y  L  L  A  V  V  V  H  V  V  L  L  R  I  C  Y  L  T  K  S
 o

5' TATAGCTGATCCTGGTTATATGCAAGGTTACGATGATTGCATGCAGCAAGGTCCAGCATCAGCTCGTGAT
 o  +----+----+----+----+----+----+----+----+----+----+----+----+----+----+  24220
 1   Y  S  .  S  W  L  Y  A  R  L  R  .  L  H  A  A  R  S  S  I  S  S  .
 2    I  A  D  P  G  Y  M  Q  G  Y  D  D  C  M  Q  Q  G  P  A  S  A  R  D
 3  L  .  L  I  L  V  I  C  K  V  T  M  I  A  C  S  K  V  Q  H  Q  L  V  I
 o

5' CTTATTTGTGCTCAATATGTGGCTGGTTACAAAGTATTACCTCCTCTTATGGATGTTAATATGGAAGCCG
 o  +----+----+----+----+----+----+----+----+----+----+----+----+----+----+  24290
 1   S  Y  L  C  S  I  C  G  W  L  Q  S  I  T  S  S  Y  G  C  .  Y  G  S  R
 2  L  I  C  A  Q  Y  V  A  G  Y  K  V  L  P  P  L  M  D  V  N  M  E  A
 3    L  F  V  L  N  M  W  L  V  T  K  Y  Y  L  L  L  W  M  L  I  W  K  P
 o

5' CGTATACTTCATCTTTGCTTGGCAGCATAGCAGGTGTTGGCTGGACTGCTGGCTTATCCTCCTTTGCTGC
 o  +----+----+----+----+----+----+----+----+----+----+----+----+----+----+  24360
 1   V  Y  F  I  F  A  W  Q  H  S  R  C  W  L  D  C  W  L  I  L  L  C  C
 2  A  Y  T  S  S  L  L  G  S  I  A  G  V  G  W  T  A  G  L  S  S  F  A  A
 3   R  I  L  H  L  C  L  A  A  .  Q  V  L  A  G  L  L  A  Y  P  P  L  L
 o

5' TATTCCATTTGCACAGAGTATCTTTTATAGGTTAAACGGTGTTGGCATTACTCAACAGGTTCTTTCAGAG
 o  +----+----+----+----+----+----+----+----+----+----+----+----+----+----+  24430
 1   Y  S  I  C  T  E  Y  L  L  .  V  K  R  C  W  H  Y  S  T  G  S  F  R
 2    I  P  F  A  Q  S  I  F  Y  R  L  N  G  V  G  I  T  Q  Q  V  L  S  E
 3  L  F  H  L  H  R  V  S  F  I  G  .  T  V  L  A  L  L  N  R  F  F  Q  R
 o

5' AACCAAAAGCTTATTGCCAATAAGTTTAATCAGGCTCTGGGAGCTATGCAAACAGGCTTCACTACAACTA
 o  +----+----+----+----+----+----+----+----+----+----+----+----+----+----+  24500
 1   E  P  K  A  Y  C  Q  .  V  .  S  G  S  G  S  Y  A  N  R  L  H  Y  N  .
 2    N  Q  K  L  I  A  N  K  F  N  Q  A  L  G  A  M  Q  T  G  F  T  T  T
 3  T  K  S  L  L  P  I  S  L  I  R  L  W  E  L  C  K  Q  A  S  L  Q  L
 o
```

Fig. 15, Cont'd

```
5'  ATGAAGCTTTTCAGAAGGTTCAGGATGCTGTGAACAACAATGCACAGGCTCTATCCAAATTAGCTAGCGA
0   +----+----+----+----+----+----+----+----+----+----+----+----+----+----+  24570
1       .  S  F  S  E  G  S  G  C  C  E  Q  Q  C  T  G  S  I  Q  I  S  .  R
2    N  E  A  F  Q  K  V  Q  D  A  V  N  N  N  A  Q  A  L  S  K  L  A  S  E
3    M  K  L  F  R  R  F  R  M  L     T  T  M  H  R  L  Y  P  N     L  A
0

5'  GCTATCTAATACTTTTGGTGCTATTTCCGCCTCTATTGGAGACATCATACAACGTCTTGATGTTCTCGAA
0   +----+----+----+----+----+----+----+----+----+----+----+----+----+----+  24640
1    A  I     Y  F  W  C  Y  F  R  L  Y  W  R  H  H  T  T  S  .  C  S  R
2    L  S  N  T  F  G  A  I  S  A  S  I  G  D  I  I  Q  R  L  D  V  L  E
3    S  Y  L  I  L  L  V  L  F  P  P  L  L  E  T  S  Y  N  V  L  M  F  S  N
0

5'  CAGGACGCCCAAATAGACAGACTTATTAATGGCCGTTTGACAACACTAAATGCTTTTGTTGCACAGCAGC
0   +----+----+----+----+----+----+----+----+----+----+----+----+----+----+  24710
1    T  G  R  P  N  R  Q  T  Y  .  W  P  F  D  N  T  K  C  F  V  A  Q
2    Q  D  A  Q  I  D  R  L  I  N  G  R  L  T  T  L  N  A  F  V  A  Q  Q
3    R  T  P  K     T  D  L  L  M  A  V     Q  H     M  L  L  L  H  S  S
0

5'  TTGTTCGTTCCGAATCAGCTGCTCTTTCCGCTCAATTGGCTAAAGATAAAGTCAATGAGTGTGTCAAGGC
0   +----+----+----+----+----+----+----+----+----+----+----+----+----+----+  24780
1    C  S  F  R  I  S  C  S  F  R  S  I  G  .  R  .  S  Q  .  V  C  Q  G
2    L  V  R  S  E  S  A  A  L  S  A  Q  L  A  K  D  K  V  N  E  C  V  K  A
3    L  F  V  P  N  Q  L  L  F  P  L  N  W  L  K  I  K  S  M  S  V  S  R
0

5'  ACAATCCAAGCGTTCTGGATTTTGCGGTCAAGGCACACATATAGTGTCCTTTGTTGTAAATGCCCCTAAT
0   +----+----+----+----+----+----+----+----+----+----+----+----+----+----+  24850
1    T  I  Q  A  F  W  I  L  R  S  R  H  T  Y  S  V  L  C  C  K  C  P  .
2    Q  S  K  R  S  G  F  C  G  Q  G  T  H  I  V  S  F  V  V  N  A  P  N
3    H  N  P  S  V  L  D  F  A  V  K  A  H  I     C  P  L  L     M  P  L  M
0

5'  GGCCTTTACTTCATGCATGTTGGTTATTACCCTAGCAACCACATTGAGGTTGTTTCTGCTTATGGTCTTT
0   +----+----+----+----+----+----+----+----+----+----+----+----+----+----+  24920
1    W  P  L  L  H  A  C  W  L  L  P  .  Q  P  H  .  G  C  F  C  L  W  S  L
2    G  L  Y  F  M  H  V  G  Y  Y  P  S  N  H  I  E  V  V  S  A  Y  G  L
3    A  F  T  S  C  M  L  V  I  T  L  A  T  T  L  R  L  F  L  L  M  V  F
0

5'  GCGATGCAGCTAACCCTACTAATTGTATAGCCCCTGTTAATGGCTACTTTATTAAAACTAATAACACTAG
0   +----+----+----+----+----+----+----+----+----+----+----+----+----+----+  24990
1    R  C  S  .  P  Y  .  L  Y  S  P  C  .  W  L  L  Y  .  N  .  H  .
2    C  D  A  A  N  P  T  N  C  I  A  P  V  N  G  Y  F  I  K  T  N  N  T  R
3    A  M  Q  L  T  L  L  I  V     P  L  M  A  T  L  L  K  L  I  T  L
0

5'  GATTGTTGATGAGTGGTCATATACTGGCTCGTCCTTCTATGCACCTGAGCCCATTACCTCCCTTAATACT
0   +----+----+----+----+----+----+----+----+----+----+----+----+----+----+  25060
1    D  C  .     V  V  I  Y  W  L  V  L  L  C  T  .  A  H  Y  L  P  .  Y
2    I  V  D  E  W  S  Y  T  G  S  S  F  Y  A  P  E  P  I  T  S  L  N  T
3    G  L  L  M  S  G  H  I  L  A  R  P  S  M  H  L  S  P  L  P  P  L  I  L
0

5'  AAGTATGTTGCACCACAGGTGACATACCAAAACATTTCTACTAACCTCCCTCCTCCTCTTCTCGGCAATT
0   +----+----+----+----+----+----+----+----+----+----+----+----+----+----+  25130
1    .  V  C  C  T  T  G  D  I  P  K  H  F  Y  .  P  P  S  S  S  R  Q  F
2    K  Y  V  A  P  Q  V  T  Y  Q  N  I  S  T  N  L  P  P  P  L  L  G  N
3    S  M  L  H  H  R  .  H  T  K  T  F  L  L  T  S  L  L  L  F  S  A  I
0

5'  CCACCGGGATTGACTTCCAAGATGAGTTGGATGAGTTTTTCAAAAATGTTAGCACCAGTATACCTAATTT
0   +----+----+----+----+----+----+----+----+----+----+----+----+----+----+  25200
1    H  R  D  .  L  P  R  .  V  G     V  F  Q  K  C  .  H  Q  Y  T  .  F
2    S  T  G  I  D  F  Q  D  E  L  D  E  F  F  K  N  V  S  T  S  I  P  N  F
3    P  P  G  L  T  S  K  M  S  W  M  S  F  S  K  M  L  A  P  V  Y  L  I
0
```

```
5'  GGGATTTTCCCTTTACCATAGTGGCCTCCCTTTACATATGTCAATCTCTAAATTGCATGCACTGGATGAT
o   +----+----+----+----+----+----+----+----+----+----+----+----+----+----+  26670
1     G  F  S  L  Y  H  S  G  L  P  L  H  M  S  I  S  K  L  H  A  L  D  D
2    R  D  F  P  F  T  I  V  A  S  L  Y  I  C  Q  S  L  N  C  M  H  W  M  M
3   G  I  F  P  L  P  .  W  P  P  F  T  Y  V  N  L  .  I  A  C  T  G  .

5'  GTTACTCGCAATTACATCATTACAATGCCATGCTTTAGAACTTACCCTCAACAAATGTTTGTTACTCCTT
o   +----+----+----+----+----+----+----+----+----+----+----+----+----+----+  26740
1     V  T  R  N  Y  I  I  T  M  P  C  F  R  T  Y  P  Q  M  F  V  T  P
2    L  L  A  I  T  S  L  Q  C  H  A  L  E  L  T  N  K  C  L  L  L
3   C  Y  S  Q  L  H  H  Y  N  A  M  L  .  N  L  P  S  T  N  V  C  Y  S  F

5'  TGGCCGTAGATGTTGTCTCCATACGGTCTTCCAATCAGGGTAATAAACAAATTGTTCATTCTTATCCCAT
o   +----+----+----+----+----+----+----+----+----+----+----+----+----+----+  26810
1     L  A  V  D  V  V  S  I  R  S  S  N  Q  G  N  K  Q  I  V  H  S  Y  P  I
2    W  P  .  M  L  S  P  Y  G  L  P  I  R  V  I  N  K  L  F  I  L  I  P
3   G  R  R  C  C  L  H  T  V  F  Q  S  G  .  T  N  C  S  F  L  S  H

5'  TTTACATCATCCAGGATTTTAACGAACTATGGCTTTCTCGGCGTCTTTATTTAAACCCGTCCAGCTAGTC
o   +----+----+----+----+----+----+----+----+----+----+----+----+----+----+  26880
1     L  H  H  P  G  F  .  R  T  M  A  F  S  A  S  L  F  K  P  V  Q  L  V
2    F  Y  I  I  Q  D  F  N  E  L  W  L  S  R  R  L  Y  L  N  P  S  S  .  S
3   F  T  S  S  R  I  L  T  N  Y  G  F  L  G  V  F  I  .  T  R  P  A  S

5'  CCAGTTTCTCCTGCATTTCATCGCATTGAGTCTACTGACTCTATTGTTTTCACATACATTCCTGCTAGCG
o   +----+----+----+----+----+----+----+----+----+----+----+----+----+----+  26950
1     P  V  S  P  A  F  H  R  I  E  S  T  D  S  I  V  F  T  Y  I  P  A  S
2    Q  F  L  L  H  F  I  A  L  S  L  L  T  L  L  F  S  H  T  F  L  L  A
3   P  S  F  S  C  I  S  S  H  .  V  Y  .  L  Y  C  F  H  I  H  S  C  .  R

5'  GCTATGTAGCTGCTTTAGCTGTCAATGTGTGTCTCATTCCCCTATTATTACTGCTACGTCAAGATACTTG
o   +----+----+----+----+----+----+----+----+----+----+----+----+----+----+  27020
1     G  Y  V  A  A  L  A  V  N  V  C  L  I  P  L  L  L  L  L  R  Q  D  T  C
2    A  M  .  L  L  .  L  S  M  C  V  S  H  S  P  Y  Y  Y  C  Y  V  K  I  L
3   L  C  S  C  F  S  C  Q  C  V  S  H  S  P  I  I  T  A  T  S  R  Y  L

5'  TCGTCGCAGCATTATCAGAACTATGGTTCTCTATTTCCTTGTTCTGTATAACTTTTTATTAGCCATTGTA
o   +----+----+----+----+----+----+----+----+----+----+----+----+----+----+  27090
1     R  R  S  I  I  R  T  M  V  L  Y  F  L  V  L  Y  N  F  L  L  A  I  V
2    V  V  A  A  L  S  E  L  W  F  S  I  S  L  F  C  I  T  F  Y  .  P  L  Y
3   S  S  Q  H  Y  Q  N  Y  G  S  L  F  P  C  S  V  .  L  F  I  S  H  C

5'  CTAGTCAATGGTGTACATTATCCAACTGGAAGTTGCCTGATAGCCTTCTTAGTTATCCTCATAATACTTT
o   +----+----+----+----+----+----+----+----+----+----+----+----+----+----+  27160
1     L  V  N  G  V  H  Y  P  T  G  S  C  L  I  A  F  L  V  I  L  I  I  L
2    .  S  M  V  Y  I  I  Q  L  E  V  A  .  P  S  L  S  S  .  Y  F
3   T  S  Q  W  C  T  L  S  N  W  K  L  P  D  S  L  L  S  Y  P  H  N  T  L

5'  AGTTTGTAGATAGAATTCGTTTCTGTCTCATGCTGAATTCCTACATTCCACTGTTTGACATGCGTTCCCA
o   +----+----+----+----+----+----+----+----+----+----+----+----+----+----+  27230
1     .  F  V  D  R  I  R  F  C  L  M  L  N  S  Y  I  P  L  F  D  M  R  S  H
2    S  L  .  I  E  F  V  S  V  S  C  .  I  P  T  F  H  C  L  T  C  V  P
3   V  C  R  .  N  S  F  L  S  H  A  E  F  L  H  S  T  V  .  H  A  F  P

5'  CTTTATTCGTGTTAGTACAGTTCTTCTCATGGTATGGTCCCTGTAATACACACCAAACCATTATTTATT
o   +----+----+----+----+----+----+----+----+----+----+----+----+----+----+  27300
1     .  F  I  R  V  S  T  V  S  S  H  G  M  V  P  V  I  H  T  K  P  L  F  I
2    T  L  F  V  L  V  Q  F  L  L  M  V  W  S  L  .  Y  T  P  N  H  Y  L  L
3   L  Y  S  C  .  Y  S  F  F  S  W  Y  G  P  C  N  T  H  Q  T  I  I  Y
```

Fig. 15, Cont'd

```
5'  AGAAACTTCGATCAGCGTTGCAGCTGTTCTCGTTGTTTTTATTTGCACTCTTCCACTTATATAGAGTGCA
0   +----+----+----+----+----+----+----+----+----+----+----+----+----+----+   27370
1     R  N  F  D  Q  R  C  S  C  S  R  C  F  Y  L  H  S  S  T  Y  I  E  C
2      E  T  S  I  S  V  A  A  V  L  V  V  F  I  C  T  L  P  L  I  .  S  A
3     .  K  L  R  S  A  L  Q  L  F  S  L  F  F  A  L  F  H  L  Y  R  V  H

5'  CTTATATTAGCCGTTTTAGTAAGATTAGCCTAGTTTCTGTAACTGACTTCTCCTTAAACGGCAATGTTTC
0   +----+----+----+----+----+----+----+----+----+----+----+----+----+----+   27440
1     T  Y  I  S  R  F  S  K  I  S  L  V  S  V  T  D  F  S  L  N  G  N  V  S
2      L  I  L  A  V  L  V  R  L  A  .  F  L  .  L  T  S  P  .  T  A  M  F
3        L  Y  .  P  F  .  D  .  P  S  F  C  N  .  L  L  L  K  R  Q  C  F

5'  CACTGTTTTCGTGCCTGCAACGCGCGATTCAGTTCCTCTTCACATAATCGCCCCGAGCTCGCTTATCGTT
0   +----+----+----+----+----+----+----+----+----+----+----+----+----+----+   27510
1     T  V  F  V  P  A  T  R  D  S  V  P  L  H  I  I  A  P  S  S  L  I  V
2     P  L  F  S  C  L  Q  R  A  I  Q  F  L  F  T  .  S  P  R  A  R  L  S  F
3     H  C  F  R  A  C  N  A  R  F  S  S  S  H  N  R  P  E  L  A  Y  R

5'  TAAGCAGCTCTGCGCTACTATGGGTCCCGTGTAGAGGCTAATCCATTAGTCTCTCTTTGGACATATGGAA
0   +----+----+----+----+----+----+----+----+----+----+----+----+----+----+   27580
1     .  A  A  L  R  Y  Y  G  S  R  V  E  A  N  P  L  V  S  L  W  T  Y  G
2     K  Q  L  C  A  T  M  G  P  V  .  R  L  I  H  .  S  L  F  G  H  M  E
3     L  S  S  S  A  L  L  W  V  P  C  R  G  .  S  I  S  L  S  L  D  I  W  K

5'  AACGAACTATGTTACCCTTTGTCCAAGAACGAATAGGGTTGTTCATAGTAAACTTTTTCATTTTTACCGT
0   +----+----+----+----+----+----+----+----+----+----+----+----+----+----+   27650
1     K  R  T  M  L  P  F  V  Q  E  R  I  G  L  F  I  V  N  F  F  I  F  T  V
2      N  E  L  C  Y  P  L  S  K  N  E  .  G  C  S  .  T  F  S  F  L  P
3        T  N  Y  V  T  L  C  P  R  T  N  R  V  V  H  S  K  L  F  H  F  Y  R

5'  AGTATGTGCTATAACACTCTTGGTGTGTATGGCTTTCCTTACGGCTACTAGATTATGTGTGCAATGTATG
0   +----+----+----+----+----+----+----+----+----+----+----+----+----+----+   27720
1     V  C  A  I  T  L  L  V  C  M  A  F  L  T  A  T  R  L  C  V  Q  C  M
2     .  Y  V  L  .  H  S  W  C  V  W  L  S  L  R  L  L  D  Y  V  C  N  V  .
3     S  M  C  Y  N  T  L  G  V  Y  G  F  P  Y  G  Y  .  I  M  C  A  M  Y

5'  ACAGGCTTCAATACCCTGTTAGTTCAGCCCGCATTATACTTGTATAATACTGGACGTTCAGTCTATGTAA
0   +----+----+----+----+----+----+----+----+----+----+----+----+----+----+   27790
1     T  G  F  N  T  L  L  V  Q  P  A  L  Y  L  Y  N  T  G  R  S  V  Y  V
2     Q  A  S  I  P  C  .  F  S  P  H  Y  T  C  I  I  L  D  V  Q  S  M  .
3     D  R  L  Q  Y  P  V  S  S  A  R  I  I  L  V  .  Y  W  T  F  S  L  C  K

5'  AATTCCAGGATAGTAAACCCCCTCTACCACCTGACGAGTGGGTTTAACGAACTCCTTCATAATGTCTAAT
0   +----+----+----+----+----+----+----+----+----+----+----+----+----+----+   27860
1     K  F  Q  D  S  K  P  P  L  P  P  D  E  W  V  .  R  T  P  S  .  C  L  I
2      N  S  R  I  V  N  P  .  T  P  Y  R  L  T  S  G  F  N  E  L  L  H  N  V  .
3        I  P  G  .  .  T  P  S  T  T  .  R  V  G  L  T  N  S  F  I  M  S  N

5'  ATGACGCAACTCACTGAGGCGCAGATTATTGCCATTATTAAAGACTGGAACTTTGCATGGTCCCTGATCT
0   +----+----+----+----+----+----+----+----+----+----+----+----+----+----+   27930
1     .  R  N  S  L  R  R  R  L  L  P  L  L  K  T  G  T  L  H  G  P  .  S
2     Y  D  A  T  H  .  G  A  D  Y  C  H  Y  .  R  L  E  L  C  M  V  P  D  L
3     M  T  Q  L  T  E  A  Q  I  I  A  I  I  K  D  W  N  F  A  W  S  L  I

5'  TTCTCTTAATTACTATCGTACTACAGTATGGATACCCATCCCGTAGTATGACTGTCTATGTCTTTAAAAT
0   +----+----+----+----+----+----+----+----+----+----+----+----+----+----+   28000
1     F  S  .  L  L  S  Y  Y  S  M  D  T  H  P  V  V  .  L  S  M  S  L  K
2      S  L  N  Y  Y  R  T  T  V  W  I  P  I  P  .  Y  D  C  L  C  L  .  N
3        F  L  L  I  T  I  V  L  Q  Y  G  Y  P  S  R  S  M  T  V  Y  V  F  K  M
```

Fig. 15, Cont'd

```
5'   GTTTGTTTTATGGCTCCTATGGCCATCTTCCATGGCGCTATCAATATTTAGCGCCGTTTATCCAATTGAT
o    +---+---+---+---+---+---+---+---+---+---+---+---+---+---+---+---+---+---+---+---+   28070
1      C  L  F  Y  G  S  Y  G  H  L  P  W  R  Y  Q  Y  L  A  P  F  I  Q  L  I
2       V  C  F  M  A  P  M  A  I  F  H  G  A  I  N  I  .  R  R  L  S  N  .
3        F  V  L  W  L  L  W  P  S  S  M  A  L  S  I  F  S  A  V  Y  P  I  D
o
5'   CTAGCTTCCCAGATAATCTCTGGCATTGTAGCAGCTGTTTCAGCTATGATGTGGATTTCCTACTTTGTGC
o    +---+---+---+---+---+---+---+---+---+---+---+---+---+---+---+---+---+---+---+---+   28140
1      .  L  P  R  .  S  L  A  L  .  Q  L  F  Q  L  .  C  G  F  P  T  L  C
2       S  S  F  P  D  N  L  W  H  C  S  S  C  F  S  Y  D  V  D  F  L  L  C  A
3        L  A  S  Q  I  I  S  G  I  V  A  A  V  S  A  M  M  W  I  S  Y  F  V
o
5'   AGAGTATCCGGCTGTTTATGAGAACTGGATCATGGTGGTCATTCAATCCTGAGACTAATTGCCTTTTGAA
o    +---+---+---+---+---+---+---+---+---+---+---+---+---+---+---+---+---+---+---+---+   28210
1      R  V  S  G  C  L  .  E  L  D  H  G  G  H  S  I  L  R  L  I  A  F  .
2       E  Y  P  A  V  Y  E  N  W  I  M  V  V  I  Q  S  .  D  .  L  P  F  E
3        Q  S  I  R  L  F  M  R  T  G  S  W  W  S  F  N  P  E  T  N  C  L  L  N
o
5'   CGTTCCATTTGGTGGTACAACTGTCGTACGTCCACTCGTAGAGGACTCTACCAGTGTAACTGCTGTTGTA
o    +---+---+---+---+---+---+---+---+---+---+---+---+---+---+---+---+---+---+---+---+   28280
1      T  F  H  L  V  V  Q  L  S  Y  V  H  S  .  R  T  L  P  V  .  L  L  L  .
2       R  S  I  W  W  Y  N  C  R  T  S  T  R  R  G  L  Y  Q  C  N  C  C  C
3        V  P  F  G  G  T  T  V  V  R  P  L  V  E  D  S  T  S  V  T  A  V  V
o
5'   ACCAATGGCCACCTCAAAATGGCTGGCATGCATTTCGGTGCTTGTGACTACGACAGACTTCCTAATGAAG
o    +---+---+---+---+---+---+---+---+---+---+---+---+---+---+---+---+---+---+---+---+   28350
1      P  M  A  T  S  K  W  L  A  C  I  S  V  L  V  T  T  D  F  L  M  K
2       N  Q  W  P  P  Q  N  G  W  H  A  F  R  C  L  .  L  R  Q  T  S  .  .  S
3        T  N  G  H  L  K  M  A  G  M  H  F  G  A  C  D  Y  D  R  L  P  N  E
o
5'   TCACCGTGGCCAAACCCAATGTGCTGATTGCTTTAAAAATGGTGAAGCGGCAAAGCTACGGAACTAATTC
o    +---+---+---+---+---+---+---+---+---+---+---+---+---+---+---+---+---+---+---+---+   28420
1      S  P  W  P  N  P  M  C  .  L  L  .  K  W  .  S  G  K  A  T  E  L  I
2       H  R  G  Q  T  Q  C  A  D  C  F  K  N  G  E  A  A  K  L  R  N  .  F
3        V  T  V  A  K  P  N  V  L  I  A  L  K  M  V  K  R  Q  S  Y  G  T  N  S
o
5'   CGGCGTTGCCATTTACCATAGATATAAGGCAGGTAATTACAGGAGTCCGCCTATTACGGCGGATATTGAA
o    +---+---+---+---+---+---+---+---+---+---+---+---+---+---+---+---+---+---+---+---+   28490
1      P  A  L  P  F  T  I  D  I  R  Q  V  I  T  G  V  R  L  L  R  R  I  L  N
2       R  R  C  H  L  P  .  I  .  G  R  .  L  Q  E  S  A  Y  Y  G  G  Y  .
3        G  V  A  I  Y  H  R  Y  K  A  G  N  Y  R  S  P  P  I  T  A  D  I  E
o
5'   CTTGCATTGCTTCGAGCTTAGGCTCTTTAGTAAGAGTATCTTAATTGATTTTAACGAATCTCAATTTCAT
o    +---+---+---+---+---+---+---+---+---+---+---+---+---+---+---+---+---+---+---+---+   28560
1      L  H  C  F  E  L  R  L  F  S  K  S  I  L  I  D  F  N  E  S  Q  F  H
2       T  C  I  A  S  S  L  G  S  L  V  R  V  S  .  L  I  L  T  N  L  N  F  I
3        L  A  L  L  R  A  .  A  L  .  E  Y  L  N  .  F  .  R  I  S  I  S
o
5'   TGTTATGGCATCCCCTGCTGCACCTCGTGCTGTTCCTTTGCCGATAACAATGATATAACAAATACAAAC
o    +---+---+---+---+---+---+---+---+---+---+---+---+---+---+---+---+---+---+---+---+   28630
1      C  Y  G  I  P  C  C  T  S  C  C  F  L  C  R  .  Q  .  V  N  K  Y  K
2       V  M  A  S  P  A  A  P  R  A  V  S  F  A  D  N  N  D  I  T  N  T  N
3        L  L  W  H  P  L  L  H  L  V  L  F  P  L  P  I  T  M  I  .  Q  I  Q  T
o
5'   CTATCTCGAGGTAGAGGACGTAATCCAAAACCACGAGCTGCACCAAATAACACTGTCTCTTGGTACACTG
o    +---+---+---+---+---+---+---+---+---+---+---+---+---+---+---+---+---+---+---+---+   28700
1      P  I  S  R  .  R  T  .  S  K  T  T  S  C  T  K  .  H  C  L  L  V  H  W
2       L  S  R  G  R  G  R  N  P  K  P  R  A  A  P  N  N  T  V  S  W  Y  T
3        Y  L  E  V  E  D  V  I  Q  N  H  E  L  H  Q  I  T  L  S  L  G  T  L
o
```

Fig. 15, Cont'd

```
5'      GGCTTACCCAACACGGGAAAGTCCCTCTTACCTTTCCACCTGGGCAGGGTGTACCTCTTAATGCCAATTC
0       +---+----+---+----+---+----+---+----+---+----+---+----+---+----+---+----+---+----+---+----+  28770
1         A  Y  P  T  R  E  S  P  S  Y  L  S  T  W  A  G  C  T  S  .  C  Q  F
2        G  L  T  Q  H  G  K  V  P  L  T  F  P  P  G  Q  G  V  P  L  N  A  N  S
3         G  L  P  N  T  G  K  S  L  L  F  H  L  G  R  V  Y  L  L  M  P  I
0
5'      TACCCCTGCGCAAAATGCTGGGTATTGGCGGAGACAGGACAGAAAAATTAATACCGGGAATGGAATTAAG
0       +---+----+---+----+---+----+---+----+---+----+---+----+---+----+---+----+---+----+---+----+  28840
1         Y  P  C  A  K  C  W  V  L  A  E  T  G  Q  K  N  .  Y  R  E  W  N
2        T  P  A  Q  N  A  G  Y  W  R  R  Q  D  R  K  I  N  T  G  N  G  I  K
3         L  P  L  R  K  M  L  G  I  G  G  D  R  T  E  K  L  I  P  G  M  E  L  S
0
5'      CAACTGGCTCCCAGGTGGTACTTCTACTACACTGGAACTGGACCCGAAGCAGCACTCCCATTCCGGGCTG
0       +---+----+---+----+---+----+---+----+---+----+---+----+---+----+---+----+---+----+---+----+  28910
1         A  T  G  S  Q  V  V  L  L  H  W  N  W  T  R  S  S  T  P  I  P  G  C
2        Q  L  A  P  R  W  Y  F  Y  Y  T  G  T  G  P  E  A  A  L  P  F  R  A
3         N  W  L  P  G  G  T  S  T  T  L  E  L  D  P  K  Q  H  S  H  S  G  L
0
5'      TTAAGGATGGCATCGTTTGGGTCCATGAAGATGGCGCCACTGATGCTCCTTCAACTTTTGGGACGCGGAA
0       +---+----+---+----+---+----+---+----+---+----+---+----+---+----+---+----+---+----+---+----+  28980
1         .  G  W  H  R  L  G  P  .  R  W  R  H  .  C  S  F  N  F  W  D  A  E
2        V  K  D  G  I  V  W  V  H  E  D  G  A  T  D  A  P  S  T  F  G  T  R  N
3         L  R  M  A  S  F  G  S  M  K  M  A  P  L  M  L  L  Q  L  L  G  R  G
0
5'      CCCTAACAATGATTCAGCTATTGTTACACAATTCGCGCCCGGTACTAAGCTTCCTAAAAACTTCCACATT
0       +---+----+---+----+---+----+---+----+---+----+---+----+---+----+---+----+---+----+---+----+  29050
1         P  .  Q  .  F  S  Y  C  Y  T  I  R  A  R  Y  .  A  S  .  K  L  P  H
2        P  N  N  D  S  A  I  V  T  Q  F  A  P  G  T  K  L  P  K  N  F  H  I
3         L  T  M  I  Q  L  L  L  H  N  S  R  P  V  L  S  F  L  K  T  S  T  L
0
5'      GAGGGGACTGGAGGCAATAGTCAATCATCTTCAAGAGCCTCTAGCTTAAGCAGAAACTCTTCCAGATCTA
0       +---+----+---+----+---+----+---+----+---+----+---+----+---+----+---+----+---+----+---+----+  29120
1         G  D  W  R  Q  .  S  I  I  F  K  S  L  .  L  K  Q  K  L  F  Q  I  .
2        E  G  T  G  G  N  S  Q  S  S  S  R  A  S  S  L  S  R  N  S  S  R  S
3         R  G  L  E  A  I  V  N  H  L  Q  E  P  L  A  .  A  E  T  L  P  D  L
0
5'      GTTCACAAGGTTCAAGATCAGGAAACTCTACCCGCGGCACTTCTCCAGGTCCATCTGGAATCGGAGCAGT
0       +---+----+---+----+---+----+---+----+---+----+---+----+---+----+---+----+---+----+---+----+  29190
1         F  T  R  F  K  I  R  K  L  Y  P  R  H  F  S  R  S  I  W  N  R  S  S
2        S  S  Q  G  S  R  S  G  N  S  T  R  G  T  S  P  G  P  S  G  I  G  A  V
3         V  H  K  V  Q  D  Q  E  T  L  P  A  A  L  L  Q  V  H  L  E  S  E  Q
0
5'      AGGAGGTGATCTACTTTACCTTGATCTTCTGAACAGACTACAAGCCCTTGAGTCTGGCAAAGTAAAGCAA
0       +---+----+---+----+---+----+---+----+---+----+---+----+---+----+---+----+---+----+---+----+  29260
1         R  R  .  S  T  L  P  .  S  S  E  Q  T  T  S  P  .  V  W  Q  S  K  A
2        G  G  D  L  L  Y  L  D  L  L  N  R  L  Q  A  L  E  S  G  K  V  K  Q
3         .  E  V  I  Y  F  T  L  I  F  .  T  D  Y  K  P  L  S  L  A  K  .  S  N
0
5'      TCGCAGCCAAAAGTAATCACTAAGAAAGATGCTGCTGCTGCTAAAAATAAGATGCGCCACAAGCGCACTT
0       +---+----+---+----+---+----+---+----+---+----+---+----+---+----+---+----+---+----+---+----+  29330
1         I  A  A  K  S  N  H  .  E  R  C  C  C  C  .  K  .  D  A  P  Q  A  H  F
2        S  Q  P  K  V  I  T  K  K  D  A  A  A  A  K  N  K  M  R  H  K  R  T
3         R  S  Q  K  .  S  L  R  K  M  L  L  L  L  K  I  R  C  A  T  S  A  L
0
5'      CCACCAAAAGTTTCAACATGGTGCAAGCTTTTGGTCTTCGCGGACCAGGAGACCTCCAGGGAAACTTTGG
0       +---+----+---+----+---+----+---+----+---+----+---+----+---+----+---+----+---+----+---+----+  29400
1         H  Q  K  F  Q  H  G  A  S  F  W  S  S  R  T  R  R  P  P  G  K  L  W
2        S  T  K  S  F  N  M  V  Q  A  F  G  L  R  G  P  G  D  L  Q  G  N  F  G
3         P  P  K  V  S  T  W  C  K  L  L  V  F  A  D  Q  E  T  S  R  E  T  L
0
```

Fig. 15, Cont'd

Fig. 15, Cont'd

```
MIHSVFLLMFLLTPTESYVDVGPDSVKSACIEVDIQQTFPDKTWPRFIDVSKADGIIYPQ
GRTYSNITITYQGLFPYQGDHGDMYVYSAGHATGTTPQKLFVANYSQDVKQFANGFVVRI
GAAANSTGTVIISPSTSATIRKIYPAFMLGSSVGNFSDGKMGRFFNHTLVLLPDGCGTLL
RAFYCILEPRSGNHCPAGNSYTSFATYHTPATDCSDGNYNRNASLNSFKEYPNLRNCTFM
YTYNITEDEILEWFGITQTAQGVRLFSSRYVDLYGGNMFQFATLPVYDTIKYYSIIPHSI
RSIQSDRKAWAAFYVYKLQPLTFLLDFSVDGYIRRAIDCGFNDLSQLHCSYESFDVESGV
YSVSSFEAKPSGSVVEQAEGVECDFSPLLSGTPPQVYNFKRLVFTNCNYNLTKLLSLFSV
NDFTCSQISPAAIASNCYSSLILDYFSYPLSMKSDLSVSSAGPISQFNYKQSFSNPTCLI
LATVPHNLTTITKPLKYSYINKCSRLLSDDRTEVPQLVNANQYSPCVSIVPSTVWEDGDY
YRKQLSPLEGGGWLVASGSTVAMTEQLQMGFGITVQYGTDTNSVCPKLEFANDTKIASQL
GNCVEYSLYGVSGRGVFQNCTAVGVRQQRFVYDAYQNLVGYYSDDGNYYCLRACVSVFVS
VIYDKETKTHATLFGSVACEHISSTMSQYSRSTRSMLKRRDSTYGPLQTPVGCVLGLVNS
SLFVEDCKLPLGQSLCALPDTPSTLTPRSVRSVPGEMRLASIAFNHPIQVDQLNSSYFKL
SIPTNFSFGVTQEYIQTTIQKVTVDCKQYVCNGFQKCEQLLREYGQFCSKINQALHGANL
RQDDSVRNLFASVKSSQSSPIIPGFGGDFNLTLLEPVSISTGSRSARSAIEDLLFDKVTI
ADPGYMQGYDDCMQQGPASARDLICAQYVAGYKVLPPLMDVNMEAAYTSSLLGSIAGVGW
TAGLSSFAAIPFAQSIFYRLNGVGITQQVLSENQKLIANKFNQALGAMQTGFTTTNEAFQ
KVQDAVNNNAQALSKLASELSNTFGAISASIGDIIQRLDVLEQDAQIDRLINGRLTTLNA
FVAQQLVRSESAALSAQLAKDKVNECVKAQSKRSGFCGQGTHIVSFVVNAPNGLYFMHVG
YYPSNHIEVVSAYGLCDAANPTNCIAPVNGYFIKTNNTRIVDEWSYTGSSFYAPEPITSL
NTKYVAPQVTYQNISTNLPPPLLGNSTGIDFQDELDEFFKNVSTSIPNFGSLTQINTTLL
DLTYEMLSLQQVVKALNESYIDLKELGNYTYYNKWPWYIWLGFIAGLVALALCVFFILCC
TGCGTNCMGKLKCNRCCDRYEEYDLEPHKVHVH
```

Fig. 16B

Domain structure HCoV-EMC S:

>EMC-S1
MIHSVFLLMFLLTPTESYVDVGPDSVKSACIEVDIQQTFFDKTWPRPIDVSKADGIIYPQ
GRTYSNITITYQGLFPYQGDHGDMYVYSAGHATGTTPQKLFVANYSQDVKQFANGFVVRI
GAAANSTGTVIISPSTSATIRKIYPAFMLGSSVGNFSDGKMGRFFNHTLVLLPDGCGTLL
RAFYCILEPRSGNHCPAGNSYTSFATYHTPATDCSDGNYNRNASLNSFKEYFNLRNCTFM
YTYNITEDEILEWFGITQTAQGVHLFSSRYVDLYGGNMFQFATLPVYDTIKYYSIIPHSI
RSIQSDRKAWAAFYVYKLQPLTFLLDFSVDGYIRRAIDCGFNDLSQLHCSYESFDVESGV
YSVSSFEAKPSGSVVEQAEGVECDFSPLLSGTPPQVYNFKRLVFTNCNYNLTKLLSLFSV
NDFTCSQISPAAIASNCYSSLILDYFSYPLSMKSDLSVSSAGPISQFNYKQSFSNPTCLI
LATVPSNLTTITKPLKYSYINKCSRLLSDDRTEVPQLVNANQYSPCVSIVPSTVWEDGDY
YRKQLSPLEGGGWLVASGSTVAMTEQLQMGFGITVQYGTDTNSVCPKLEFANDTKIASQL
GNCVEYSLYGVSGRGVFQNCTAVGVRQQRFVYDAYQNLVGYYSDDGNYYCLRACVSVPVS
VIYDKETKTHATLFGSVACEHISSTMSQYSRSTRSMLKRRDSTYGPLQTPVGCVLGLVNS
SLFVEDCKLPLGQSLCALPDTPSTLTP

S1 domains:

| Domain: | EMC S residues: |
|---|---|
| N-domain | 1-357 (harbours MHV RBD homologous domain) |
| C-domain | 358-747 |
| C-subdomain | 358-588 (harbours SARS-CoV RBD homologous domain) |

Fig. 17

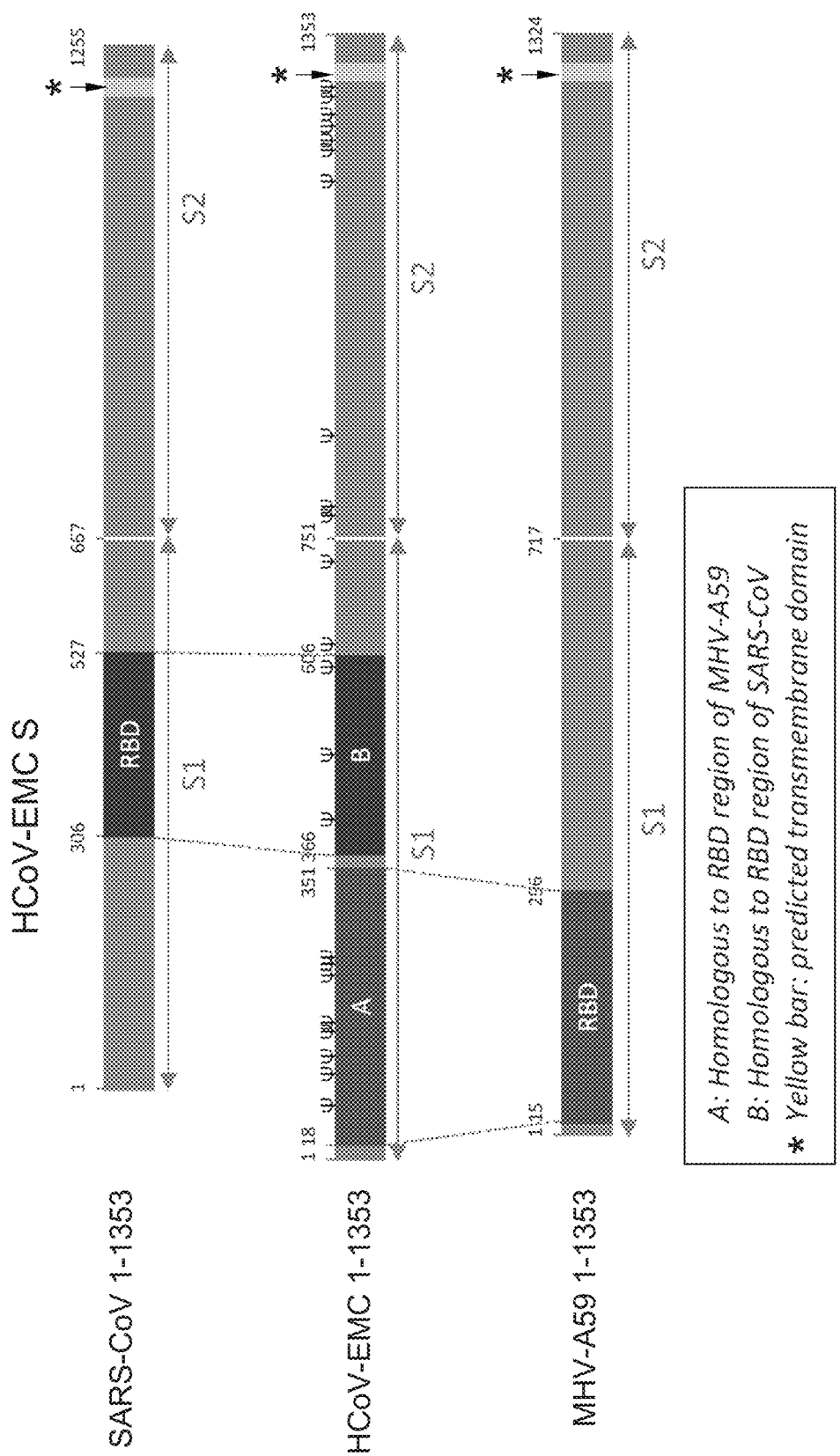
Fig. 17, Cont'd

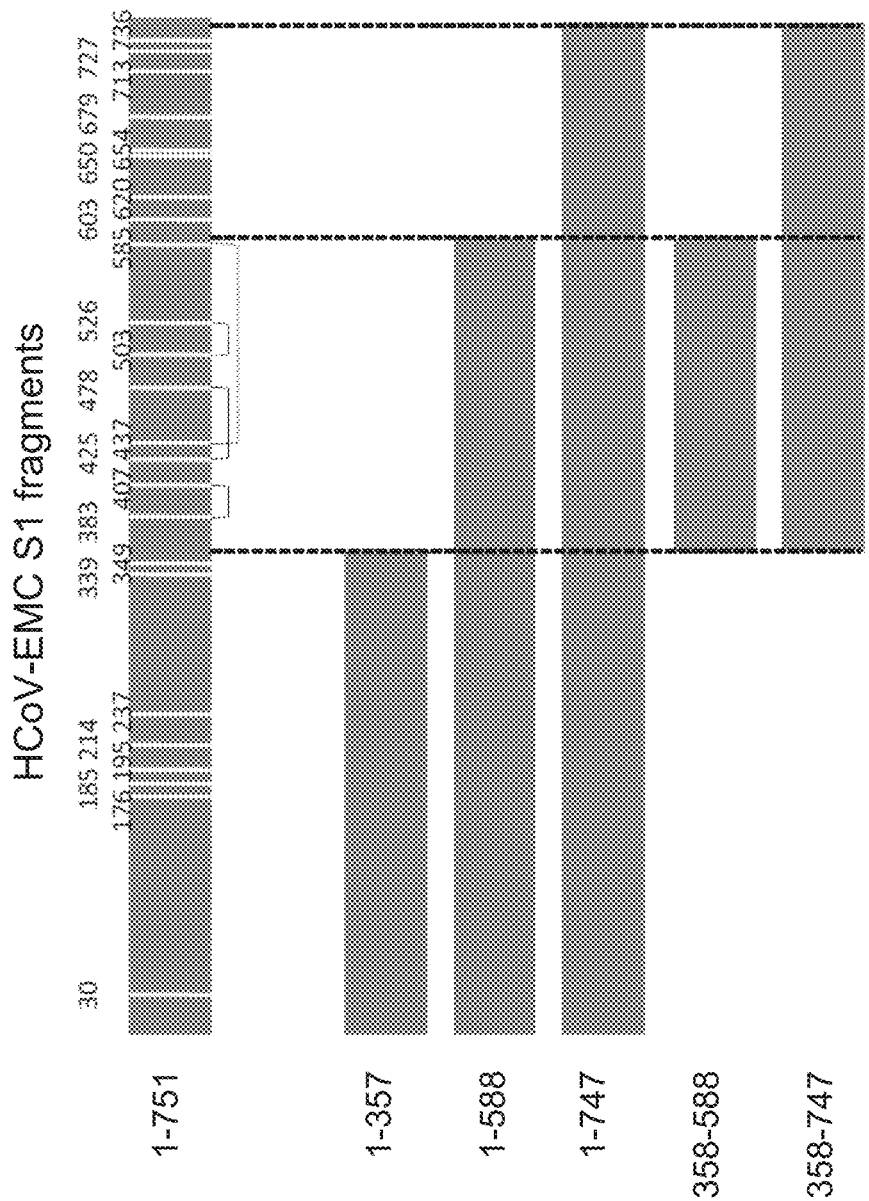
Fig. 17, Cont'd

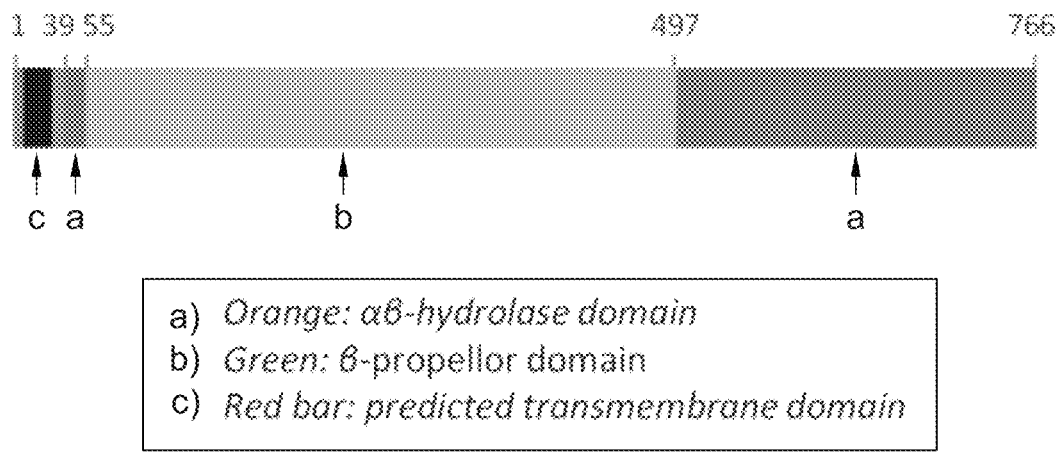

Domain structure human DPP-IV:

```
>gi|18765694|ref|NP_001926.2| dipeptidyl peptidase 4 [Homo sapiens]
MKTPWKVLLGLLGAAALVTIITVPVVLLNKGTDDATADSRKTYTLTDYLKNTYRLKLYSLRWISDHEYLY
KQENNILVFNAEYGNSSVFLENSTFDEFGHSINDYSISPDGQFILLEYNYVKQWRHSYTASYDIYDLNKR
QLITEERIPNNTQWVTWSPVGHKLAYVWNNDIYVKIEPNLPSYRITWTGKEDIIYNGITDWVYEEEVFSA
YSALWWSPNGTFLAYAQFNDTEVPLIEYSFYSDESLQYPKTVRVFPYPKAGAVNPTVKFFVVNTDSLSSVT
NATSIQITAPASMLIGDHYLCDVTWATQERISLQWLRRIQNYSVMDICDYDESSGRWNCLVARQHIEMST
TGWVGRFRPSEPHFTLDGNSFYKIISNEEGYRHICYFQIDKKDCTFITKGTWEVIGIEALTSDYLYYISN
EYKGMPGGRNLYKIQLSDYTKVTCLSCELNPERCQYYSVSFSKEAKYYQLRCSGPGLPLYTLHSSVNDKG
LRVLEDNSALDKMLQNVQMPSKKLDFIILNETKFWYQMILPPHFDKSKKYPLLLDVYAGPCSQKADTVFR
LNWATYLASTENIIVASFDGPGSGYQGDKIMHAINRRLGTFEVEDQIEAARQFSKMGFVDNKRIAIWGWS
YGGYVTSMVLGSGSGVFKCGIAVAPVSRWEYYDSVYTERYMGLPTPEDNLDHYRNSTVMSRAENFKQVEY
LLIHGTADDNVHFQQSAQISKALVDVGVDFQAMWYTDEDHGIASSTAHQHIYTHMSRFIKQCFSLP
```

Residues 1-766:       human DPP-IV
Residues 1-6:         cytoplasmic tail
Residues 7-28:        transmembrane region human DPP-IV
Residues 29-38:       region connecting transmembrane region and αβ-hydrolase domain
Residues 39-766:      Naturally occuring soluble form of DPP-IV Domains in the DPP-IV ectodomain:
Residues 55-497:      β-propellor domain in green
Residues 39-51 and 506-766:   αβ-hydrolase domain in grey Domain borders based on crystal structure (Rasmussen Nat.Struct.Biol. 2003)

Fig. 18

```
  1 MKTFWKVLLG LLGAAALVTI ITVPVVLLNK GTDDATADSR KTYTLTDYLK
 51 NTYRLKLYSL RWISDHEYLY KQENNILVFN AEYGNSSVFL ENSTFDEFGH
101 SINDYSISPD GQFILLEYNY VKQWRHSYTA SYDIYDLNKR QLITEERIPN
151 NTQWVTWSPV GHKLAYVWNN DIYVKIEPNL PSYRITWTGK EDIIYNGITD
201 WVYEEEVFSA YSALWWSPNG TFLAYAQFND TEVPLIEYSF YSDESLQYPK
251 TVRVPYPKAG AVNPTVKFFV VNTDSLSSVT NATSIQITAP ASMLIGDHYL
301 CDVTWATQER ISLQWLRRIQ NYSVMDICDY DESSGRWNCL VARQHIEMST
351 TGWVGRFRPS EPHFTLDGNS FYKIISNEEG YRHICYFQID KKDCTFITKG
401 TWEVIGIEAL TSDYLYYISN EYKGMPGGRN LYKIQLSDYT KVTCLSCELN
451 PERCQYYSVS FSKEAKYYQL RCSGPGLPLY TLHSSVNDKG LRVLEDNSAL
501 DKMLQNVQMP SKKLDFIILN ETKFWYQMIL PPHFDKSKKY PLLLDVYAGP
551 CSQKADTVFR LNWATYLAST ENIIVASFDG RGSGYQGDKI MHAINRRLGT
601 FEVEDQIEAA RQFSKMGFVD NKRIAIWGWS YGGYVTSMVL GSGSGVFKCG
651 IAVAPVSRWE YYDSVYTERY MGLPTPEDNL DHYRNSTVMS RAENFKQVEY
701 LLIHGTADDN VHFQQSAQIS KALVDVGVDF QAMWYTDEDH GIASSTAHQH
751 IYTHMSHFIK QCFSLP
```

Fig. 21

Fig. 30B

```
>EMC_S
MIHSVFLLMFLLTPTESYVDVGPDSVKSACIEVDIQQTFFDKTWPRPIDVSKADGIIYPQ
GRTYSNITITYQGLFPYQGDHGDMYVYSAGHATGTTPQKLFVANYSQDVKQFANGFVVRI
GAAANSTGTVIISPSTSATIRKIYPAFMLGSSVGNFSDGKMGRFFNHTLVLLPDGCGTLL
RAFYCILEPRSGNHCPAGNSYTSFATYHTPATDCSDGNYNRNASLNSFKEYFNLRNCTFM
YTYNITEDEILEWFGITQTAQGVHLFSSRYVDLYGGNMFQFATLPVYDTIKYYSIIPHSI
RSIQSDRKAWAAFYVYKLQPLTFLLDFSVDGYIRRAIDCGFNDLSQLHCSYESFDVESGV
YSVSSFEAKPSGSVVEQAEGVECDFSPLLSGTPPQVYNFKRLVFTNCNYNLTKLLSLFSV
NDFTCSQISPAAIASNCYSSLILDYFSYPLSMKSDLSVSSAGPISQFNYKQSFSNPTCLI
LATVPHNLTTITKPLKYSYINKCSRLLSDDRTEVPQLVNANQYSPCVSIVPSTVWEDGDY
YRKQLSPLEGGGWLVASGSTVAMTEQLQMGFGITVQYGTDTNSVCPKLEFANDTKIASQL
GNCVEYSLYGVSGRGVFQNCTAVGVRQQRFVYDAYQNLVGYYSDDGNYYCLRACVSVPVS
VIYDKETKTHATLFGSVACEHISSTMSQYSRSTRSMLKRRDSTYGPLQTPVGCVLGLVNS
SLFVEDCKLPLGQSLCALPDTPSTLTPRSVRSVPGEMRLASIAFNHPIQVDQLNSSYFKL
SIPTNFSFGVTQEYIQTTIQKVTVDCKQYVCNGFQKCEQLLREYGQFCSKINQALHGANL
RQDDSVRNLFASVKSSQSSPIIPGFGGDFNLTLLEPVSISTGSRSARSAIEDLLFDKVTI
ADPGYMQGYDDCMQQGPASARDLICAQYVAGYKVLPPLMDVNMEAAYTSSLLGSIAGVGW
TAGLSSFAAIPFAQSIFYRLNGVGITQQVLSENQKLIANKFNQALGAMQTGFTTTNEAFQ
KVQDAVNNNAQALSKLASELSNTFGAISASIGDIIQRLDVLEQDAQIDRLINGRLTTLNA
FVAQQLVRSESAALSAQLAKDKVNECVKAQSKRSGFCGQGTHIVSFVVNAPNGLYFMHVG
YYPSNHIEVVSAYGLCDAANPTNCIAPVNGYFIKTNNTRIVDEWSYTGSSFYAPEPITSL
NTKYVAPQVTYQNISTNLPPPLLGNSTGIDFQDELDEFFKNVSTSIPNFGSLTQINTTLL
DLTYEMLSLQQVVKALNESYIDLKELGNYTYYNKWPWYIWLGFIAGLVALALCVFFILCC
TGCGTNCMGKLKCNRCCDRYEEYDLEPHKVHVH

>HKU5_S
MIRSVLVLMCSLTFIGNLTRGQSVDMGHNGTGSCLDSQVQPDYFESVHTTWPMPIDTSKAEGVIYPNGKS
YSNITLTYTGLYPKANDLGKQYLFSDGHSAPGRLNNLFVSNYSSQVESFDDGFVVRIGAAANKTGTTVIS
QSTFKPIKKIYPAFLLGHSVGNYTPSNRTGRYLNHTLVILPDGCGTILHAFYCVLHPRTQQNCAGETNFK
SLSLWDTPASDCVSGSYNQEATLGAFKVYFDLINCTFRYNYTITEDENAEWFGITQDTQGVHLYSSRKEN
VFRNNMFHFATLPVYQKILYYTVIPRSIRSPFNDRKAWAAFYIYKLHPLTYLLNFDVEGYITKAVDCGYD
DLAQLQCSYESFEVETGVYSVSSFEASPRGEFIEQATTQECDFTPMLTGTPPPIYNFKRLVFTNCNYNLT
KLLSLFQVSEFSCHQVSPSSLATGCYSSLTVDYFAYSTDMSSYLQPGSAGAIVQFNYKQDFSNPTCRVLA
TVFQNLTTITKPSNYAYLTECYKTSAYGKNYLYNAPGAYTPCLSLASRGFSTKYQSHSDGELTTTGYIYP
VTGNLQMAFIISVQYGTDTNSVCPMQALRNDTSIEDKLDVCVEYSLHGITGRGVFHNCTSVGLPNQRFVY
DTFDNLVGYHSDNGNYYCVRPCVSVPVSVIYDKASNSHATLFGSVACSHVTTMMSQFSRMTKTNLLARTT
PGPLQTTVGCAMGFINSSMVVDECQLPLGQSLCAIPPTTSSRVRRATSGASDVFQIATLNFTSPLTLAPI
NSTGFVVAVPTNFTFGVTQEFIETTIQKITVDCKQYVCNGFKKCEDLLKEYGQFCSKINQALHGANLRQD
ESIANLFSSIKTQNTQPLQAGLNGDFNLTMLQIPQVTTGERKYRSTIEDLLFNKVTIADPGYMQGYDECM
QQGPQSARDLICAQYVAGYKVLPPLYDPYMEAAYTSSLLGSIAGASWTAGLSSFAAIPFAQSIFYRLNGV
GITQQVLSENQKIIANKFNQALGAMQTGFTTTNLAFNKVQDAVNANAMALSKLAAELSNTFGAISSSISD
ILARLDTVEQEAQIDRLINGRLTSLNAFVAQQLVRTEAAARSAQLAQDKVNECVKSQSKRNGFCGTGTHI
VSFAINAPNGLYFFHVGYQPTSHVNATAAYGLCNTENPQKCIAPIDGYFVLNQTTSTVADSDQQWYYTGS
SFFHPEPITE

>HKU4_S
MTLLMCLLMSLLIFVRGCDSQFVDMSPASNTSECLESQVDAAAFSKLMWPYPIDPSKVDGIIYPLGRTYS
NITLAYTGLFPLQGDLGSQYLYSVSHAVGHDGPTKAYISNYSLLVNDFDNGFVVRIGAAANSTGTIVIS
PSVNTKIKKAYPAFILGSSLTNTSAGQPLYANYSLTIIPDGCGTVLHAFYCILKPRTVNRCPSGTGYVSY
FIYETVHNDCQSTINRNASLNSFKSFFDLVNCTFFNSWDITADETKEWFGITQDTQGVHLYSSRKGDLYG
GNMFRFATLPVYEGIKYYTVIPRSFRSKANKREAWAAFYVYKLHQLTYLLDFSVDGYIRRAIDCGHDDLS
QLHCSYTSFEVDTGVYSVSSYEASATGTFIEQPNATECDFSPMLTGVAPQVYNFKRLVFSNCNYNLTKLL
SLFAVDEFSCNGISPDSIARGCYSTLTVDYFAYPLSMKSYIRPGSAGNIPLYNYKQSFANPTCRVMASVL
ANVTITKPHAYGYISKCSRLTGANQDVETPLYINPGEYSICRDFSPGGFSEDGQVFKRTLTQFEGGGLLI
GVGTRVPMTDNLQMSFIISVQYGTGTDSVCPMLDLGDSLTITNRLGKCVDYSLYGVTGRGVFQNCTAVGV
KQQRFVYDSFDNLVGYYSDDGNYYCVRPCVSVPVSVIYDKSTNLHATLFGSVACEHVTTMMSQFSRLTQS
NLRRRDSNIPLQTAVGCVIGLSNNSLVVSDCKLPLGQSLCAVPPVSTFRSYSASQFQLAVLNYTSPIVVT
PINSSGFTAAIPTNFSFSVTQEYIETSIQKVTVDCKQYVCNGFTRCEKLLVEYGQFCSKINQALHGANLR
QDESVYSLYSNIKTTSTQTLEYGLNGDFNLTLLQVPQIGGSSSSYRSAIEDLLFDKVTIADPGYMQGYDD
CMKQGPQSARDLICAQYVSGYKVLPPLYDPNMEAAYTSSLLGSIAGAGWTAGLSSFAAIPFAQSMFYRLN
GVGITQQVLS

Fig. 32, Cont'd

Fig. 32, Cont'd

```
              1010       1020       1030       1040       1050       1060       1070       1080       1090       1100
                |          |          |          |          |          |          |          |          |          |
HKU5_S    VLSENQKLIANKFNQALGAMQTGFTTTNLAFMKVQDAVNANAMALSKLAAELSNTFGAISSSISDILARLDTVEQEAQIDRLINGRLITSLNAFVAQQLVR
HKU4_S    VLSENQKLIANKFNQALGAMQTGFTTSNLAFSKVQDAVNANAQALSKLASELSNTFGAISSSISDILARLDTVEQEAQIDRLINGRLITSLNAFVSQQLVR
EMC_Sx0   VLSENQKLIANKFNQALGAMQTGFTTTNEAFQKVQDAVNNAQALSKLASELSNTFGAISASIGDIIQRLDVLEQDAQIDRLINGRLTTLNAFVAQQLVR
          ********:******************:*:** :*******:****:***********:*:**:*:**:**:********:**********:*****
Prim.cons. VLSENQKLIANKFNQALGAMQTGFTTTNLAFMKVQDAVNANAQALSKLASELSNTFGAISSSISDILARLDTVEQDAQIDRLINGRLITSLNAFVAQQLVR 1110       1120       1130       1140       1150       1160       1170       1180       1190       1200
                |          |          |          |          |          |          |          |          |          |
HKU5_S    TEAAARSAQLAQDKVNECVKSQSKKRNGFCGSTHIVSFAINAPNGLYFFHVGIQPTSHVNATAAYGLCNTENPQKCIAPIDGIFVLNQTTTSTVADSDQQW
HKU4_S    SETAARSAQLASDKVNECVRSQSKKRNGFCGSGTHIVSFVVNAPNGFTFFHVGYFPTNYTHVTAAYGLCNNNPPLCIAPIDGIFTNQTTIYSVDT--BM
EMC_Sx0   SESAALSAQLAKDKVNECVKAQSKRSGFCGQGTHIVSFVVNAPNGLYFMHVGYYPSNHIRVVSAYGLCDAARPTNCIAPVNGYFIKTN-NTRIVDE---M
          **:**:*****.******::***::****. ******.*****:.*:***  *.:* :*:::******: *    *.****::* *:: ::  :*   
Prim.cons. SESAARSAQLA3DKVNECVKSQSKRNGFCG3GTHIVSFVVNAPNGLYFPHVGY3PTNH3NVTAAYGLCN3NP33CIAPIDGYFI3NQTTT33VD3DQ2W 1210       1220       1230       1240       1250       1260       1270       1280       1290       1300
                |          |          |          |          |          |          |          |          |          |
HKU5_S    YYTGSSFFHPEPITEAMSKNVSMDVKFENLTNRLPPLLSNSTDLDFKEELEPFKMVSSQGPNFQEISKINTTLLNLMTELMVLSEVVKQLNESYIDLK
HKU4_S    YYTGSSFYKPEPITQANSRYVSSDVKFKDKLENNLPPLLENSTDVDFKDELEPFKNEAEISKINTTLLDLSDEMAMLQEVVKQLNDSYIDLK
EMC_Sx0   SYTGSSFYAPEPITSLNTKIVAPQVTYQNISTNLPPPLLGNSTGIDFWDELDRFFKNVSSIPNFGSLTQINTTLLDLTYEMLSLQQVVRALNESYIDLK
          ********:..****. ::*.* ** :::  . *****:*:*** :**:**: ******* ***:*****:. .. *. *:*****:******
Prim.cons. YYTGSSFY3PKPIT3ANSKTVS3DVKF3NL3NRLPPFLL3NSTD3DFKDELERFFKNVSS3GPNF3KI3KINTTLLDL33EM33LQEVVKQLNESYIDLK 1310       1320       1330       1340       1350       1360
                |          |          |          |          |          |
HKU5_S    ELGNYTFYQKMPWYIWLGFIAGLVALALCVFFILCCTGCGTSCLGKLKCNRCCDSYEEYEVE---KIHVH
HKU4_S    ELGNYTYYNKWPWYIWLGFIAGLVALLLCVFFILCCTGCGTSCLGKMKCNCCDSYEBYDVE---KIHVH
EMC_Sx0   ELGNYTYYNKWPWYIWLGFIAGLVALALCVFFILCCTGCGTNCGKLKCNRCCDRYEEYDLEPHKVRVH
          ****** :*:*:*************** ************. * *:*** ***.**:* *    ****
Prim.cons. ELGNYTYYNKMPWYIWLGFIAGLVALALCVFFILCCGCGTSCLGKLKCNRCCDSYERYDVEPRKINVH
```

Alignment data:
Alignment length : 1369
Identity (*) : 766 is 55.95 %
Str

Fig. 33C

HUMAN BETACORONAVIRUS LINEAGE C AND IDENTIFICATION OF N-TERMINAL DIPEPTIDYL PEPTIDASE AS ITS VIRUS RECEPTOR

RELATED APPLICATIONS

This application is a U.S. National Stage of PCT/IB/2013/058772, which claims priority from U.S. Provisional Application Ser. No. 61/831,070 filed Jun. 4, 2013; 61/730,027 filed Nov. 26, 2012; and 61/704,531 filed Sep. 23, 2012, each of which is expressly incorporated by reference herein in its entirety.

The invention provides a new previously undescribed Coronavirus isolated from cases of unexplained disease in September 2012 and identified herein as belonging to a newly recognized and previously undescribed species of human Corona Virus (HCoV), herein identified as HCoV-SA1 or HCoV EMC or Middle East Respiratory Syndrome-Coronavirus (MERS-CoV). In particular the nucleic acid and/or amino acid sequences of the MERS-CoV genome and sequences specifically encoding (parts of) viral proteins and antigenic polypeptides are provided. Further, the invention relates to diagnostic means and methods, prophylactic means and methods and therapeutic means and methods to be employed in the diagnosis, prevention and/or treatment of disease, in particular of respiratory disease, in particular of mammals, more in particular in humans. It particularly also relates to an isolated virus and its receptor.

A fundamental yet unresolved puzzle in virology is how viruses evolve to recognize their receptor proteins on the cells they need to enter in order to replicate. Specifically, how do different viruses recognize the same receptor protein and how do similar viruses recognize different receptor proteins? Do viruses select their receptor proteins by chance or do they target specific virus binding hotspots on these receptor proteins? Structural information of virus-receptor interfaces can potentially answer these questions. To date, although a few studies have obtained structural information for a single virus-receptor interface, even less studies have provided structural information for the interfaces between different viruses and their common receptor protein.

The invention in particular relates to coronaviruses that are the second leading cause of adult colds. Of the more than 30 kinds, three or four infect humans. The 2003 SARS virus is a coronavirus. Coronaviruses are rather difficult to grow in the laboratory, so they have not been studied to the same extent as other viruses. NL63 coronavirus (NL63 CoV), a prevalent human respiratory virus, is a group I coronavirus known to use angiotensin converting enzyme 2 (ACE2, a cell membrane bound carboxy terminal dipeptidyl peptidase) as its receptor. Incidentally, ACE2 is also used by group II SARS coronavirus (SARS CoV).

The distribution of coronavirus receptors is critical to the pathogenic outcome of the disease they cause. In this regard, it is notable that coronavirus spikes exhibit a wide range of receptor specificities; human aminopeptidase N (a metalloprotease) is a receptor for human coronavirus 229E, mouse hepatitis virus enters after binding members of a pleiotropic family of carcinoembryonic antigen cell adhesion molecules (CEACAMs); feline and porcine coronaviruses also bind various metalloproteases; and bovine coronaviruses recognize 9 O acetylated sialic acids.

Coronaviruses enter cells through a large spike protein on their envelopes. The coronavirus spike protein is a membrane anchored trimer and contains two subunits, receptor binding subunit S1 and membrane fusion subunit S2. The S2 subunits from group I and group II coronaviruses share both sequence and structural homology; they contain homologous heptad repeat segments that fold into a conserved trimers of hairpin structure, which is essential for membrane fusion. Surprisingly, the S1 subunits from group I and group II coronaviruses have no obvious sequence homology. Nevertheless, they can be divided approximately into N terminal region, central region, and C terminal region. Coronaviruses are believed to have common ancestors because they share similar replication mechanisms, genomic structures, and overall gene sequences.

Among all of the coronavirus genes, the one encoding the spike protein is the most variable. Between the spike protein subunits, S1 is more variable than S2. The current structural divergences of the S1 subunits reveal the tremendous evolutionary pressure that coronaviruses face to adapt to different host receptors, and they also reflect on the evolutionary history of coronaviruses and their receptor selections.

In general, coronaviruses are well known and most of those who are diagnosed with it recover completely with no complications after receiving the needed supportive therapy. However, in some of the patients who are infected, serious complications can develop affecting the respiratory system and the kidneys and can cause death, especially among the elderly and in patients with chronic respiratory and cardiac conditions and among immune compromised patients.

Coronaviruses (CoVs), a genus of the Coronaviridae family, are positive strand RNA viruses with the largest viral genome of all RNA viruses (27-32 Kb). The genomic RNA is capped, polyadenylated and covered with nucleocapsid proteins. The virus is enveloped and carries large spike glycoproteins. All CoVs employ a common genome organization where the replicase gene encompasses the 5' two thirds of the genome and is comprised of two overlapping open reading frames (ORFs), ORF1a and ORF1b.

The structural gene region, which covers the 3' third of the genome, encodes the canonical set of structural protein genes in the order 5' spike (S) envelope (E) membrane (M) and nucleocapsid (N)-3'. Some beta CoVs carry an additional structural protein encoding a hemagglutinin esterase (HE). The gene is located between the ORF1b and S gene. Expression of the nonstructural replicase proteins is mediated by translation of the genomic RNA that gives rise to the biosynthesis of two large polyproteins, pp1a (encoded by ORF1a) and pp1ab (encoded by ORF1a and ORF1b) facilitated by a ribosomal frame shift at the ORF1a/1b junction.

In contrast, the structural proteins are translated from sub genomic (sg) mRNAs. These sg mRNAs are the result of discontinuous transcription, a hallmark of CoV gene expression. The structural gene region also harbors several ORFs that are interspersed along the structural protein coding genes. The number and location of these accessory ORFs varies between the CoV species.

Although coronaviruses were first identified nearly 60 years ago, they only received notoriety in 2003 when one of their members was identified as the aetiological agent of severe acute respiratory syndrome (SARS). Previously these viruses were known to be important agents of respiratory and enteric infections of domestic and companion animals and to cause approximately 15% of all cases of the common cold. Coronaviruses (CoVs), a genus of the Coronaviridae family, are positive strand RNA viruses with the largest viral genome of all RNA viruses (27-32 Kb). The genomic RNA is capped, polyadenylated and covered with nucleocapsid proteins. The virus is enveloped and carries large spike glycoproteins. All CoVs employ a common genome organization where the replicase gene encompasses the 5'-two thirds of the genome and is comprised of two overlapping open reading frames (ORFs), ORF1a and ORF1b. The structural gene region, which covers the 3'-third of the genome, encodes the canonical set of structural protein genes in the order 5'-spike (S)-envelope (E)-membrane (M) and nucleocapsid (N)-3'. Some beta-CoVs carry an additional structural protein encoding a heamagglutinin-esterase (HE). The gene is located between the ORF1b and S gene. Expression of the nonstructural replicase proteins is mediated by translation of the genomic RNA that gives rise to the biosynthesis of two large polyproteins, pp1a (encoded by ORF1a) and pp1ab (encoded by ORF1a and ORF1b) facilitated by a ribosomal frame shift at the ORF1a/1b junction. In contrast, the structural proteins are translated from sub genomic (sg) mRNAs. These sg mRNAs are the result of discontinuous transcription, a hallmark of CoV gene expression. The structural gene region also harbors several ORFs that are interspersed along the structural protein coding genes. The number and location of these accessory ORFs varies between the CoV species. In animals CoV infections can lead to a variety of syndromes, e.g. bronchitis, gastroenteritis, progressive demyelinating encephalitis, diarrhea, peritonitis and respiratory tract disease. The first reports on human CoVs (HCoV) appeared in the mid-1960s. The human viruses were isolated from persons with common cold, and two species were detected: HCoV-229E and HCoV-OC43. Almost 40 years later, SARS-CoV was identified as the causative agent of the Severe Acute Respiratory Syndrome (SARS). A highly effective global public health response prevented further spread of this virus, and as a result SARS-CoV was eradicated from the human population. Soon thereafter it became clear that there are more HCoVs. HCoV-NL63 was identified in 2004 and HCoV-HKU1 in 2005. Both viruses are not emerging viruses like SARS-CoV but were previously unidentified. In fact, infections by these viruses are as common and wide spread as HCoV-229E and HCoV-OC43 infections. The SARS outbreak intensified the research on the unknown animal CoVs. As much as 16 new animal CoV species were identified till 2008. There are currently at around 29 complete reference genome sequences available in Genbank of the various viruses. Recently, the Coronavirus Study Group of the International Committee for Taxonomy of Viruses has proposed renaming the traditional group 1, 2, and 3 coronaviruses into the genus *Alphacoronavirus, Betacoronavirus,* and *Gammacoronavirus*, respectively (http://talk.ictvonline.org/media/p/1230.aspx). Each genus is subdivided into different species on the basis of sequence identity in the replicase domains of the polyprotein pp1ab.

The classification of the family Coronaviridae and the organization of the established subfamily Coronavirinae is based upon rooted phylogeny and pair-wise comparisons using Coronaviridae-wide conserved domains in replicase polyprotein pp1ab as well as the structural proteins S, E, M and N. In rooted trees, the proposed genera Alpha-, Beta- and *Gammacoronavirus* consistently form three distinct monophyletic groups and in pair-wise comparisons, they form three robust non-overlapping clusters. The inter-group pair-wise scores for coronaviruses are comparable to those calculated for structural and non-structural proteins of different genera in other RNA virus families (e.g. Potyviridae, Picornaviridae). Based on this defacto criterion phylogroups 1 through 3 are named into genera designated Alpha-, Beta and *Gammacoronavirus*, respectively. The 90% aa sequence identity threshold now proposed as a species demarcation criterion within each genus has been determined from the analysis of pair-wise aa distances in seven conserved replicase domains (nsp3 ADRP, nsp5 (3CLpro), nsp12 (RdRp), nsp13 (He11), nsp14 (ExoN), nsp15 (NendoU) and nsp16 (0-MT)) of 156 viruses in the Coronaviridae. In this analysis, 20 distinct groups (17 coronaviruses, 2 toroviruses, 1 bafinivirus) are unambiguously recognized as non-overlapping clusters (with the largest intra-cluster distance being smaller than the smallest inter-cluster distance). Of these clusters, at least 7 fall into the genus *Betacoronavirus*, each of which represents a distinct *betacoronavirus* species (*Betacoronavirus* 1, Murine coronavirus, Human coronavirus HKU1, Rousettus bat coronavirus HKU9, Tylonycteris bat coronavirus HKU4, Pipistrellus bat coronavirus HKU5, Severe acute respiratory syndrome-related coronavirus (SARS-CoV). The *Betacoronavirus* genus is additionally considered to contain 4 lineages (A, B, C and D). Human coronaviruses HCoV-HKU1 and HCoV-OC43 belong to lineage A while human coronavirus SARS-CoV belongs to lineage B. Lineage C and D are not known to contain any human representatives. Other human coronaviruses, such as HCoV-NL63 and HCoV-229E, are even more distinct since these two human pathogens belong to a different genus, the *Alphacoronavirus* genus.

The invention also relates to so called "pull down" experiments, which are methods for the identification of protein protein interactions based on affinity purification of interacting proteins from complex proteinaceous substances such as cellular extracts. Pull down experiments with, for example, fusion proteins attached to inert beads are a screening technique for isolating proteinaceous substances having specific protein components that bind to each other and thus lead to identification of protein protein interactions.

Typically, pull down experiments are used to identify interactions between a probe protein and unknown targets and to confirm suspected interactions between a probe protein and a known protein. When coupled with peptide digests of pulled down proteins and with mass spectrometry to sequence those peptides and identify targets, pull downs can be considered as the protein based equivalent of a yeast two hybrid screen.

To improve the isolation of specific binding partners, pull down methods have been developed involving the use of cross linking, of large scale tissue lysates, and of spin columns. Appropriate methods of sample preparation for mass spectrometry based identification of interacting proteins have been developed as well, including specialized gel staining techniques, band excision, and in gel tryptic digestion. Data interpretation and most commonly encountered problems are, for example, discussed in Current Protocols in Cell Biology, "UNIT 17.5 Protein Protein Interactions Identified by Pull Down Experiments and Mass Spectrometry," Adam Brymora, Valentina A. Valova, and Phillip J. Robinson, Published Online: 1 May 2004 DOI: 10.1002/0471143030.cb1705s22, and included herein by reference.

The Invention

The invention provides an isolated essentially mammalian positive-sense single stranded RNA virus classifiable as belonging to the Order: Nidovirales; Family: Coronaviridae; Subfamily: Coronavirinae; Genus: *Betacoronavirus*; and non-Lineage A, non-Lineage B or non-Lineage D, human *betacoronavirus*. The invention also provides a human virus (the prefix human stands for the virus classified as capable of infecting humans where a bat virus is capable of infecting bats), preferably isolated or isolatable from humans, having a receptor binding domain (RBD) capable of binding to a dipeptidyl peptidase 4 (DPP4), no such isolates have been deposited or in any other way made available to the art until now. In particular, the invention provides an isolated essentially mammalian positive-sense single stranded RNA virus classifiable as belonging to the Order: Nidovirales; Family: Coronaviridae; Subfamily: Coronavirinae; Genus: *Betacoronavirus*; Lineage C human *betacoronavirus*. The invention also provides an isolated essentially mammalian positive-sense single stranded RNA virus classifiable as belonging to the Order: Nidovirales; Family: Coronaviridae; Subfamily: Coronavirinae; Genus: *Betacoronavirus*; Lineage: C and isolatable from humans, and components thereof. Until now, no *Betacoronavirus* isolates have been isolated from humans that were then classified as belonging to Lineage: C of *Betacoronavirus*. In particular, the invention provides a Lineage: C human *Betacoronavirus* having a receptor binding domain (RBD) capable of binding to a dipeptidyl peptidase 4 (DPP4). In particular, no such isolates have been deposited or in any other way made available to the art until now. In a preferred embodiment, a virus according to the invention is isolated or isolatable from a human. In particular, the invention provides a new previously undescribed Coronavirus isolated from cases of unexplained disease in September 2012 and identified herein as belonging to a newly recognized and previously undescribed species of human Corona Virus (HCoV), herein identified as HCoV-SA1 or HCoV EMC or Middle East Respiratory Syndrome-Coronavirus (MERS-CoV). In particular the specific nucleic acid and/or amino acid sequences of the MERS-CoV genome and sequences encoding (parts of) viral proteins and antigenic polypeptides are provided, as demonstrated by phylogenetic analyses. Further, the invention relates to diagnostic means and methods, prophylactic means and methods and therapeutic means and methods to be employed in the diagnosis, prevention and/or treatment of disease, in particular of respiratory disease, in particular of mammals, more in particular in humans, most in particular specific for MERS-CoV. It particularly also relates to an isolated virus and its receptor. The invention also provides identification of N-terminal dipeptidyl peptidase as virus receptor and uses thereof, identification of the receptor binding domain of MERS-CoV mapping to a 231-residue region 2 in the spike protein that efficiently elicits neutralizing antibodies identification and uses thereof and dipeptidyl peptidase 4 receptor determinants of respiratory MERS-coronavirus infection, and uses thereof. The invention in particular provides specific diagnostics of MERS-CoV, subunit compositions of S1-MERS CoV protein for vaccine purposes, screening tests for detecting compounds capable of interfering with MER-CoV-DPP4 binding, and animal models for determining activity of compounds capable of interfering with MERS-CoV-DPP4 binding.

The invention also provides a virus according to the invention comprising one or more of a nucleic acid or fragment thereof selected from any of FIGS. 3 or 5 to 15, preferably wherein said virus provided herein is having an amino acid sequence of its conserved replicase domain that is at least 75%, more preferably at least 80%, more preferably at least 85%, more preferably at least 90%, most preferably at least 95% identical with the amino acid sequence of the conserved replicase domain of an isolated essentially mammalian positive-sense single stranded RNA virus classifiable as belonging to the Order: Nidovirales; Family: Coronaviridae; Subfamily: Coronavirinae; Genus: *Betacoronavirus*; Lineage C isolatable from humans and comprising one or more of the sequences selected from any of FIGS. 3 or 5 to 15, preferably wherein said conserved replicase domain comprises ORF1ab.

The invention also provides a virus according to the invention having an amino acid sequence of its receptor binding domain that is at least 75%, more preferably at least 80%, more preferably at least 85%, more preferably at least 90%, most preferably at least 95% identical with the amino acid sequence of the receptor binding domain of an isolated essentially mammalian positive-sense single stranded RNA virus classifiable as belonging to the Order: Nidovirales; Family: Coronaviridae; Subfamily: Coronavirinae; Genus: *Betacoronavirus*; Lineage C isolatable from humans and comprising one or more of the sequences selected from any of FIGS. 3 or 5 to 15, preferably wherein said receptor domain comprises residues 1 747 of the S1 spike protein, preferably residues 358 588 of the S1 spike protein.

In a one embodiment, a virus is provided that belongs to the Coronaviruses, genus *Betacoronavirus* and is identifiable as phylogenetically corresponding or specific to the MERS-CoV thereto by determining a nucleic acid or amino acid sequence of said virus or fragments thereof and testing it in phylogenetic tree analyses wherein maximum likelihood trees are generated and finding it, the virus or fragment, to be more closely phylogenetically corresponding to a virus isolate or fragment thereof having the sequences as depicted in any of FIGS. 3 or 5 to 15 than it is corresponding to a bat coronavirus HKU4 or HKU5, or fragments thereof, in another embodiment, a virus is provided that belongs to the Coronaviruses and is identifiable as phylogenetically corresponding or specific to the MERS-CoV thereto by determining a nucleic acid sequence or amino acid sequence of said virus and testing it in phylogenetic tree analyses wherein maximum likelihood trees are generated and finding it to be more closely phylogenetically corresponding to a virus isolate isolatable from humans having the sequences as depicted in any of FIGS. 3 or 5 to 15 than it is corresponding to a human coronavirus virus isolate HCoV-HKU1 or HCoV-OC43 or SARS-CoV, or fragments thereof.

In a preferred embodiment, a virus is provided herein that belongs to the Coronaviruses, genus *Betacoronavirus* and is identifiable as phylogenetically corresponding thereto by determining a nucleic acid or amino acid sequence of said virus and testing it in phylogenetic tree analyses wherein maximum likelihood trees are generated and finding it to be more closely phylogenetically corresponding to a virus isolate having the sequences as depicted in any of FIGS. 3 or 5 to 15 than it is corresponding to a bat coronavirus HKU4 or HKU5 or to a human coronavirus virus isolate HCoV-HKU1 or HCoV-OC43 or SARS-CoV.

The invention also provides a cell, preferably a host cell, and a culture of such a cell or host cell, i.e. a cultured cell, comprising a virus according to the invention. Preferred examples of such cells and cell cultures comprise a Vero cell or LLC-MK2 cell and cultures thereof; other preferred examples comprise a Huh-7 cell, a primary nonciliated human airway epithelial cell, a primary human fibroblast, a primary human kidney cell, a primary human alveolar type 2 cell, or a primary kidney cell of Pipistrellus pipistrellu, and cultures of said cells.

The invention also provides a nucleic acid, preferably a cDNA, or MERS-CoV-specific fragment thereof obtainable, derived or obtained from an isolated essentially mammalian positive-sense single stranded RNA virus classifiable as belonging to the Order: Nidovirales; Family: Coronaviridae; Subfamily: Coronavirinae; Genus: *Betacoronavirus*; and non-Lineage A, non-Lineage B or non-Lineage D, human *betacoronavirus*. In a preferred embodiment, the invention provides a nucleic acid isolatable from a human virus, preferably isolatable from humans, having a receptor binding domain (RBD) capable of binding to a dipeptidyl peptidase 4 (DPP4), In particular, a nucleic acid is provided by the invention obtainable, derived or obtained from an isolated essentially mammalian positive-sense single stranded RNA virus classifiable as belonging to the Order: Nidovirales; Family: Coronaviridae; Subfamily: Coronavirinae; Genus: *Betacoronavirus*; Lineage C human *betacoronavirus*. a nucleic acid is provided by the invention obtainable, derived or obtained from an isolated essentially mammalian positive-sense single stranded RNA virus classifiable as belonging to the Order: Nidovirales; Family: Coronaviridae; Subfamily: Coronavirinae; Genus: *Betacoronavirus*; Lineage: C and isolatable from humans, and components thereof. Until now, no *Betacoronavirus* isolates have been isolated from humans that were then classified as belonging to Lineage: C of *Betacoronavirus*. In particular, a nucleic acid is provided by the invention obtainable, derived or obtained from a Lineage: C *Betacoronavirus* having a receptor binding domain (RBD) capable of binding to a dipeptidyl peptidase 4 (DPP4), preferably from a virus having a nucleic acid sequence at least 75%, more preferably at least 80%, more preferably at least 85%, more preferably at least 90%, most preferably at least 95% identical with a nucleic acid sequence provided in FIG. 3 or FIGS. 5 to 15. In particular, a MERS-CoV specific fragment of a nucleic acid, RNA or DNA or cDNA is provided by the invention which comprises one or more of the sequences of MERS-CoV as depicted in FIGS. 3, or 5 to 15 or a nucleic acid sequence which can hybridize with any of these sequences under stringent conditions. The invention also provides a vector comprising a nucleic acid according to the invention, and a host cell comprising a nucleic acid according to the invention or a vector according to the invention.

The invention also provides an isolated or recombinant proteinaceous molecule or MERS-CoV-specific fragment thereof encoded by a nucleic acid according to the invention. In a preferred embodiment, the invention provides a proteinaceous molecule or MERS-CoV-specific viral protein or fragment thereof encoded by a nucleic acid according to the invention. Useful proteinaceous molecules are for example derived from any of the genes or genomic fragments or open reading frames (ORFs) derivable from a virus according to the invention. Such molecules, or antigenic fragments thereof, as provided herein, are for example useful in diagnostic methods or kits and in pharmaceutical compositions such as sub-unit vaccines and inhibitory peptides. Particularly useful is the viral polymerase protein, the spike protein, the nucleocapsid or antigenic fragments thereof for inclusion as antigen or subunit immunogen in a vaccine, but inactivated whole virus can also be used. Particularly useful are also those proteinaceous substances that are encoded by recombinant nucleic acid fragments that are identified by phylogenetic analyses as being MERS-CoV specific fragments, of course preferred are those that are within the preferred bounds and metes of ORFs useful in phylogenetic analyses, in particular for eliciting MERS-CoV specific antibodies, whether in vivo (e.g. for protective purposes or for providing diagnostic antibodies) or in vitro (e.g. by phage display technology or another technique useful for generating synthetic antibodies).

In one embodiment, the invention provides a viral replicase or MERS-CoV-specific fragment thereof having an amino acid sequence at least 75%, more preferably at least 80%, more preferably at least 85%, more preferably at least 90%, most preferably at least 95% identical with an amino acid sequence provided in FIG. 13, said viral replicase or MERS-CoV-specific fragment thereof preferably encoded by an RNA or DNA or cDNA sequence or fragments or homologues thereof as provided herein, having a nucleic acid sequence at least 75%, more preferably at least 80%, more preferably at least 85%, more preferably at least 90%, most preferably at least 95% identical with a nucleic acid sequence provided in FIG. 13.

In another embodiment, the invention provides a viral spike protein or MERS-CoV-specific fragment thereof having an amino acid sequence at least 75%, more preferably at least 80%, more preferably at least 85%, more preferably at least 90%, most preferably at least 95% identical with an amino acid sequence provided in FIG. 12, said viral spike protein or MERS-CoV-specific fragment thereof preferably encoded by an RNA or DNA or cDNA sequence or fragments or homologues thereof as provided herein, having a nucleic acid sequence at least 75%, more preferably at least 80%, more preferably at least 85%, more preferably at least 90%, most preferably at least 95% identical with a nucleic acid sequence provided in FIG. 12.

In another embodiment, the invention provides an S1 spike protein or MERS-CoV-specific fragment thereof having an amino acid sequence at least 75%, more preferably at least 80%, more preferably at least 85%, more preferably at least 90%, most preferably at least 95% identical with an amino acid sequence provided for residues 1 588 in FIG. 17.

In another embodiment, the invention provides an S1 spike protein or MERS-CoV-specific fragment thereof having an amino acid sequence at least 75%, more preferably at least 80%, more preferably at least 85%, more preferably at least 90%, most preferably at least 95% identical with an amino acid sequence provided for residues 1 357 in FIG. 17.

In another embodiment, the invention provides an S1 spike protein or MERS-CoV-specific fragment thereof having an amino acid sequence at least 75%, more preferably at least 80%, more preferably at least 85%, more preferably at least 90%, most preferably at least 95% identical with an amino acid sequence provided for residues 358 747 in FIG. 17.

In another embodiment, the invention provides an S1 spike protein or MERS-CoV-specific fragment thereof having an amino acid sequence at least 75%, more preferably at least 80%, more preferably at least 85%, more preferably at least 90%, most preferably at least 95% identical with an amino acid sequence provided for residues 358-588 in FIG. 17.

In another embodiment, the invention provides an S1 spike protein or MERS-CoV-specific fragment thereof having an amino acid sequence at least 75%, more preferably at least 80%, more preferably at least 85%, more preferably at least 90%, most preferably at least 95% identical with an amino acid sequence provided for residues 589 747 in FIG. 17.

In another embodiment, the invention provides an S1 spike protein or MERS-CoV-specific fragment thereof having an amino acid sequence at least 75%, more preferably at least 80%, more preferably at least 85%, more preferably at least 90%, most preferably at least 95% identical with an amino acid sequence provided for residues 1 747 in FIG. 17.

In another embodiment, the invention provides an S1 spike protein or MERS-CoV-specific fragment thereof having an amino acid sequence at least 75%, more preferably at least 80%, more preferably at least 85%, more preferably at least 90%, most preferably at least 95% identical with an amino acid sequence provided for residues 1 747 in FIG. 17.

Figure 8:
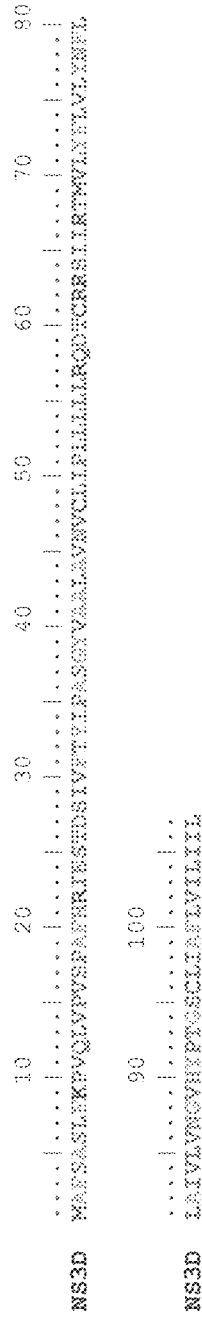

In another embodiment, the invention provides a viral non-structural gene protein or MERS-CoV-specific fragment thereof having an amino acid sequence at least 75%, more preferably at least 80%, more preferably at least 85%, more preferably at least 90%, most preferably at least 95% identical with an amino acid sequence provided in FIG. 8, said viral non-structural gene protein or MERS-CoV-specific fragment preferably encoded by an RNA or DNA or cDNA sequence or fragments or homologues thereof as provided herein, having a nucleic acid sequence at least 75%, more preferably at least 80%, more preferably at least 85%, more preferably at least 90%, most preferably at least 95% identical with a nucleic acid sequence provided in FIG. 8.

Figure 9:
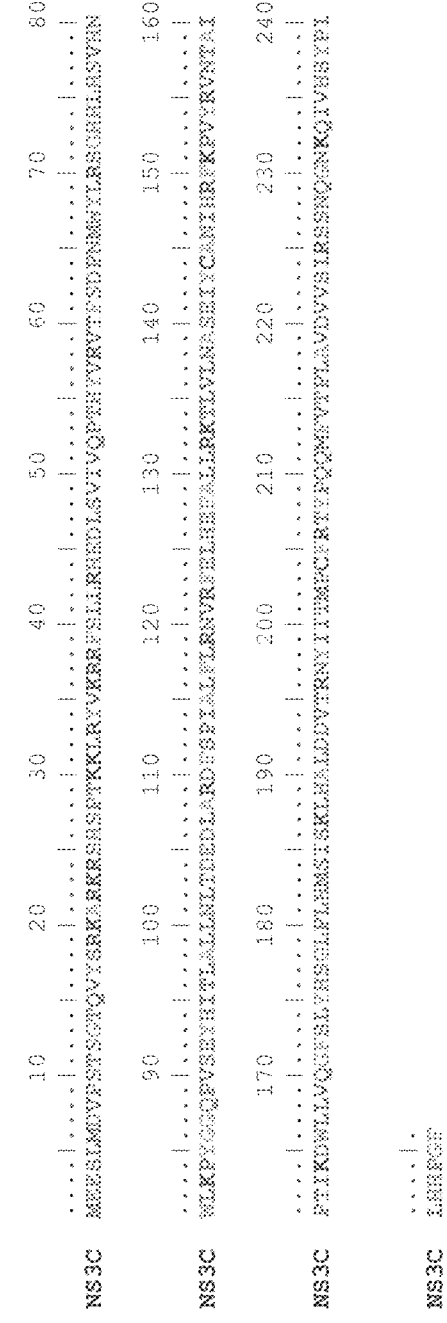

In another embodiment, the invention provides a viral non-structural gene protein or MERS-CoV-specific fragment thereof having an amino acid sequence at least 75%, more preferably at least 80%, more preferably at least 85%, more preferably at least 90%, most preferably at least 95% identical with an amino acid sequence provided in FIG. 9, said viral non-structural gene protein or MERS-CoV-specific fragment preferably encoded by an RNA or DNA or cDNA sequence or fragments or homologues thereof as provided herein, having a nucleic acid sequence at least 75%, more preferably at least 80%, more preferably at least 85%, more preferably at least 90%, most preferably at least 95% identical with a nucleic acid sequence provided in FIG. 9.

Figure 10:
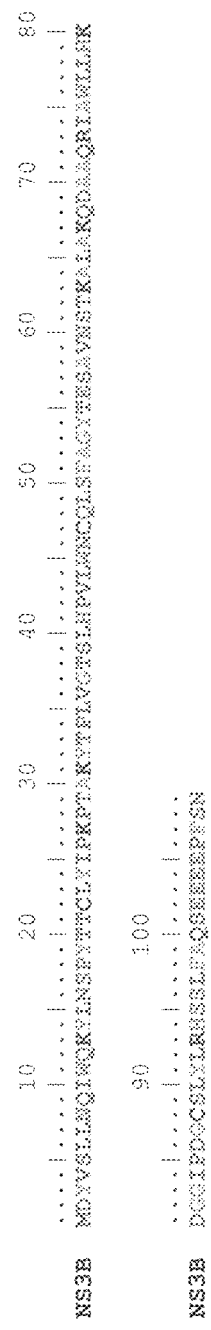

In another embodiment, the invention provides a viral non-structural gene protein or MERS-CoV-specific fragment thereof having an amino acid sequence at least 75%, more preferably at least 80%, more preferably at least 85%, more preferably at least 90%, most preferably at least 95% identical with an amino acid sequence provided in FIG. 10, said viral non-structural gene protein or MERS-CoV-specific fragment preferably encoded by an RNA or DNA or cDNA sequence or fragments or homologues thereof as provided herein, having a nucleic acid sequence at least 75%, more preferably at least 80%, more preferably at least 85%, more preferably at least 90%, most preferably at least 95% identical with a nucleic acid sequence provided in FIG. 10.

Figure 11:
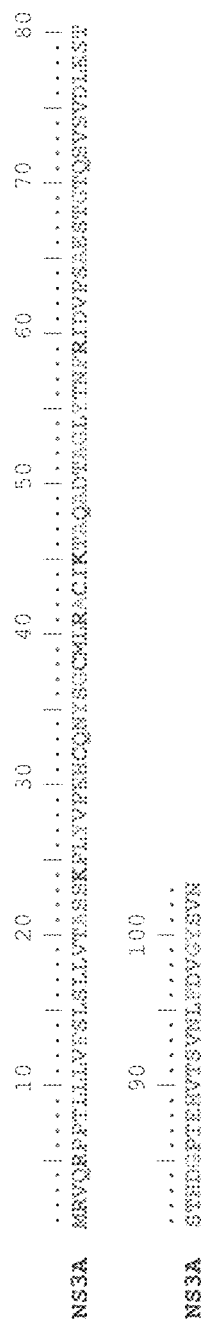

In another embodiment, the invention provides a viral non-structural gene protein or MERS-CoV-specific fragment thereof having an amino acid sequence at least 75%, more preferably at least 80%, more preferably at least 85%, more preferably at least 90%, most preferably at least 95% identical with an amino acid sequence provided in FIG. 11, said viral non-structural gene protein or MERS-CoV-specific fragment preferably encoded by an RNA or DNA or cDNA sequence or fragments or homologues thereof as provided herein, having a nucleic acid sequence at least 75%, more preferably at least 80%, more preferably at least 85%, more preferably at least 90%, most preferably at least 95% identical with a nucleic acid sequence provided in FIG. 11.

Figure 7:
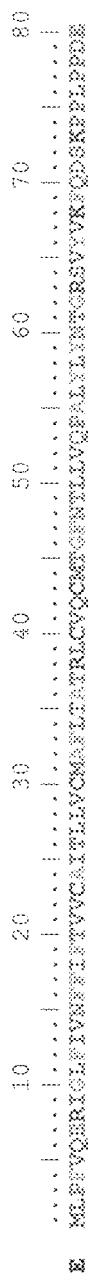

In another embodiment, the invention provides a viral small envelope (E) protein or MERS-CoV-specific fragment thereof having an amino acid sequence at least 75%, more preferably at least 80%, more preferably at least 85%, more preferably at least 90%, most preferably at least 95% identical with an amino acid sequence provided in FIG. 7, said viral small envelope (E) protein or MERS-CoV-specific fragment preferably encoded by an RNA or DNA or cDNA sequence or fragments or homologues thereof as provided herein, having a nucleic acid sequence at least 75%, more preferably at least 80%, more preferably at least 85%, more preferably at least 90%, most preferably at least 95% identical with a nucleic acid sequence provided in FIG. 7.

Figure 6:
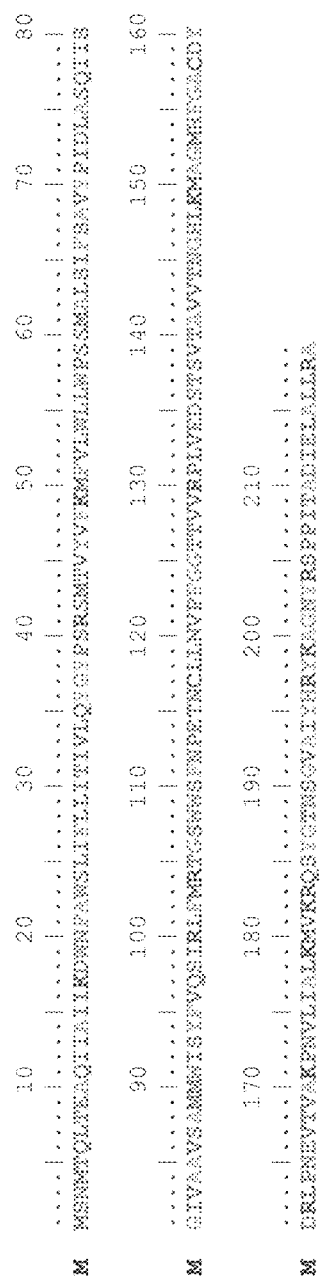

In another embodiment, the invention provides a viral matrix (M) protein or MERS-CoV-specific fragment thereof having an amino acid sequence at least 75%, more preferably at least 80%, more preferably at least 85%, more preferably at least 90%, most preferably at least 95% identical with an amino acid sequence provided in FIG. 6, said viral matrix (M) protein or MERS-CoV-specific fragment preferably encoded by an RNA or DNA or cDNA sequence or fragments or homologues thereof as provided herein, having a nucleic acid sequence at least 75%, more preferably at least 80%, more preferably at least 85%, more preferably at least 90%, most preferably at least 95% identical with a nucleic acid sequence provided in FIG. 6.

Figure 5:
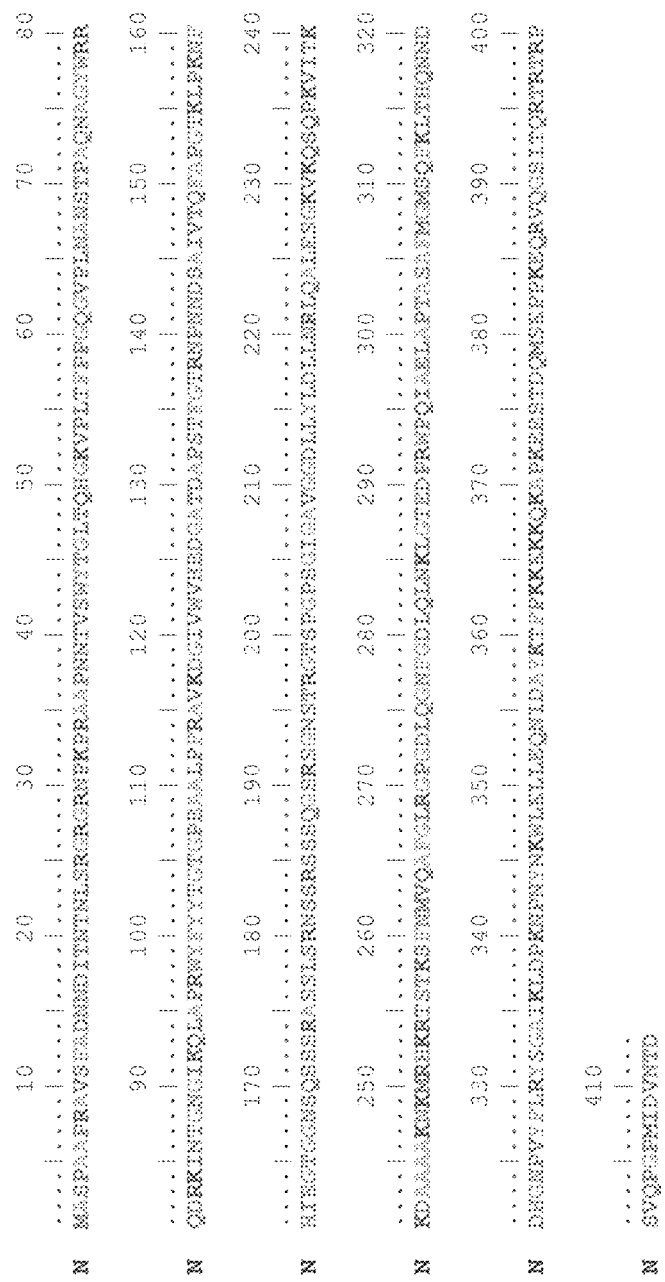

In another embodiment, the invention provides a nucleocapsid (N) protein or MERS-CoV-specific fragment thereof having an amino acid sequence at least 75%, more preferably at least 80%, more preferably at least 85%, more preferably at least 90%, most preferably at least 95% identical with an amino acid sequence provided in FIG. 5, said nucleocapsid (N) protein or MERS-CoV-specific fragment preferably encoded by an RNA or DNA or cDNA sequence or fragments or homologues thereof as provided herein, having a nucleic acid sequence at least 75%, more preferably at least 80%, more preferably at least 85%, more preferably at least 90%, most preferably at least 95% identical with a nucleic acid sequence provided in FIG. 5.

The invention also provides an antigen comprising a proteinaceous molecule or MERS-CoV-specific fragment thereof as provided herein. In a preferred embodiment, said proteinaceous molecule comprises or consists of a nucleocapsid (N) protein or MERS-CoV-specific fragment thereof as provided herein, or a viral matrix (M) protein or MERS-CoV-specific fragment thereof as provided herein, or a viral small envelope (E) protein or MERS-CoV-specific fragment thereof as provided herein, or a viral non-structural gene protein or MERS-CoV-specific fragment as provided herein, or an S1 spike protein or MERS-CoV-specific fragment thereof as provided herein, or a viral spike protein or MERS-CoV-specific fragment thereof as provided herein or of a viral replicase or MERS-CoV-specific fragment thereof as provided herein.

Also provided herein are antibodies, be it natural polyclonal or monoclonal, or synthetic (e.g. (phage) library-derived binding molecules) antibodies that specifically react with an antigen comprising a proteinaceous molecule or MERS-CoV-specific fragment thereof according to the invention. A person skilled in the art will be able to develop (monoclonal) antibodies using isolated virus material anchor recombinantly expressed viral proteins. In particular the invention provides a rabbit antibody specifically directed against an antigen according to the invention, rabbits being particularly well suited to raise antibodies against an antigen according to the invention. Such antibodies are also useful in a method for identifying a viral isolate as a MERS-CoV comprising reacting said viral isolate or a component thereof with an antibody as provided herein. This can for example be achieved by using purified or non-purified MERS-CoV or parts thereof (proteins, peptides) using ELISA, RIA, FACS or similar formats of antigen detection assays (Current Protocols in Immunology). Alternatively, infected cells or cell cultures may be used to identify viral antigens using classical immunofluorescence or immunohistochemical techniques. Specifically useful in this respect are antibodies raised against MERS-CoV proteins or peptides which are encoded by a nucleotide sequence comprising one or more of the fragments disclosed in FIGS. 3 and 5 to 15. Antibodies, both monoclonal and polyclonal, or fragments thereof, can also be used for detection purpose in the present invention, for example, in immunoassays in which they can be utilized in liquid phase or bound to a solid phase carrier.

In addition, the monoclonal antibodies in these immunoassays can be detectably labeled in various ways. A variety of immunoassay formats may be used to select antibodies specifically reactive with a particular protein (or other analyte). For example, solid-phase ELISA immunoassays are routinely used to select monoclonal antibodies specifically immunoreactive with a protein. See Harlow and Lane, Antibodies, A Laboratory Manual, Cold Spring Harbor Publications, New York (1988), for a description of immunoassay formats and conditions that can be used to determine selective binding. Examples of types of immunoassays that can utilize antibodies of the invention are competitive and non-competitive immunoassays in either a direct or indirect format. Examples of such immunoassays are the radioimmunoassay (RIA) and the sandwich (immunometric) assay. Detection of the antigens using the antibodies of the invention can be done utilizing immunoassays that are run in either the forward, reverse, or simultaneous modes, including immunohistochemical assays on physiological samples. Those of skill in the art will know, or can readily discern, other immunoassay formats without undue experimentation.

Antibodies can be bound to many different carriers and used to detect the presence of the target molecules. Examples of well-known carriers include glass, polystyrene, polypropylene, polyethylene, dextran, nylon, amylases, natural and modified celluloses, polyacrylamides, agaroses and magnetite. The nature of the carrier can be either soluble or insoluble for purposes of the invention. Those skilled in the art will know of other suitable carriers for binding monoclonal antibodies, or will be able to ascertain such using routine experimentation.

The invention also provides method for identifying a viral isolate as a *Betacoronavirus*, Lineage C comprising reacting said viral isolate or a component thereof with a nucleic acid according to the invention anchor with an antibody according to the invention. The invention for example provides a method for virologically diagnosing a MERS-CoV infection of an animal, in particular of a mammal, more in particular of a human being, comprising determining in a sample of said animal the presence of a viral isolate or component thereof by reacting said sample with a MERS-CoV specific nucleic acid or antibody according to the invention, and a method for serologically diagnosing a MERS-CoV infection of a mammal comprising determining in a sample of said mammal the presence of an antibody specifically directed against a MERS-CoV or component thereof by reacting said sample with a MERS-CoV-specific proteinaceous molecule or fragment thereof or an antigen according to the invention.

The invention also provides a diagnostic kit for diagnosing a MERS-CoV infection comprising a MERS-CoV, a MERS-CoV-specific nucleic acid, proteinaceous molecule or fragment thereof, antigen anchor an antibody according to the invention, and preferably a means for detecting said MERS-CoV, MERS-CoV-specific nucleic acid, proteinaceous molecule or fragment thereof, antigen anchor an antibody, said means for example comprising an excitable group such as a fluorophore or enzymatic detection system used in the art (examples of suitable diagnostic kit format comprise IF, ELISA, neutralization assay, RT-PCR assay). To determine whether an as yet unidentified virus component or synthetic analogue thereof such as nucleic acid, proteinaceous molecule or fragment thereof can be identified as MERS-CoV-specific, it suffices to analyze the nucleic acid or amino acid sequence of said component, for example for a stretch of said nucleic acid or amino acid, preferably of at least 10, more preferably at least 25, more preferably at least 40 nucleotides or amino acids (respectively), by sequence homology comparison with the provided MERS-CoV nucleic acid or amino acid sequences and with known non-MERS-CoV nucleic acid or amino acid sequences using for example phylogenetic analyses as provided herein. Depending on the degree of relationship with said MERS-CoV or non-MERS-CoV viral sequences, the component or synthetic analogue can be identified.

The invention also provides use of a virus according to the invention, anchor a nucleic acid according to the invention, a vector according to the invention, a host cell according the invention, a proteinaceous molecule or fragment thereof according to the invention, an antigen according to the invention, or an antibody according to the invention for the production of a pharmaceutical composition, preferably for the production of a pharmaceutical composition for therapeutical use, preferably for use in antiviral therapy, preferably for the treatment or prevention of a *Betacoronavirus*, Lineage C virus infection, preferably a human infection, preferably an infection with a MERS-Cov, or for the production of a pharmaceutical composition for the treatment or prevention of atypical pneumonia and/or renal failure, preferably wherein said atypical pneumonia and/or renal failure is a human disease. Preferably a peptide comprising part of the amino acid sequence of the spike protein as depicted in FIG. 17 (residues 358-588, comprising the essential receptor binding domain) is used for the preparation of a therapeutic or prophylactic peptide, preferably for inclusion in said pharmaceutical composition. Also preferably, a protein comprising the amino acid sequence of the spike protein as depicted in FIG. 17 (residues 358-588) is used for the preparation of a sub-unit vaccine. Furthermore, the nucleocapsid of Coronaviruses, as depicted in FIG. 5, is known to be particularly useful for eliciting cell-mediated immunity against Coronaviruses and can be used for the preparation of a sub-unit vaccine. The invention also comprises a pharmaceutical composition comprising a virus according to the invention, and/or a nucleic acid according to the invention, a vector according to the invention, a host cell according the invention, a proteinaceous molecule or fragment thereof according to the invention, an antigen according to the invention, or an antibody according to the invention.

The invention also provides a method for the treatment or prevention of a *Betacoronavirus*, Lineage C virus infection or for the treatment or prevention of atypical pneumonia comprising providing a mammal, preferably a human individual with a pharmaceutical composition according to the invention. Also, the invention provides a method for the treatment or prevention of atypical pneumonia and/or renal failure comprising providing an individual with a pharmaceutical composition according to the invention. In a preferred embodiment, a method for the treatment or prevention of a MERS-CoV infection is provided comprising providing a mammal with a pharmaceutical composition according the invention, preferably wherein said mammal is a rabbit. The invention also provides a method for in vivo determining of parameters of MERS-CoV infection, preferably for determining parameters of MERS-CoV-DPP4 interaction in an animal experiment, comprising providing a mammal with a pharmaceutical composition according to the invention, anchor with a virus according to the invention, and/or with a nucleic acid according to the invention, and/or with a vector according to the invention, and/or with a host cell according to the invention, and/or with a proteinaceous molecule or fragment thereof according to the invention, and/or with an antigen according to the invention, and/or with an antibody according to the invention, preferably wherein said mammal is a rabbit. It is herein found that rabbits have several advantages over other experimental animals in that they have a remarkably similar target sequence for MERS-CoV-DPP4-receptor interaction, resulting in proficient infection of a rabbit with MERS-CoV and thus ample chance to study various aspects and parameters of MERS-CoV-DPP4-receptor interaction that resemble those in humans, giving the rabbit experimental animal model a distinct advantage over other animal models, such as the ferret animal model. Phylogenetic analysis of the MERS-CoV binding region of DPP4 indicated that human, macaque, horse and rabbit DPP4 cluster together as do DPP4's from cattle, pig and bats, that are somewhat more distantly related. Small animals including ferret, mice and most likely hamsters, shown to resist MERS-CoV infection, are more divergent in the DPP4 virus binding region, which at least in the case of ferrets has consequences for MERS-CoV binding. Besides macaques, rabbits indeed are a potential animal model for MERS-CoV infection; ex vivo inoculation of rabbit lung and kidney tissues revealed susceptibility to MERS-CoV. Similarly, the invention provides a method for in vivo determining of parameters of MERS-CoV infection, preferably for determining parameters of protection against MERS-CoV-infection, comprising providing a mammal with a pharmaceutical composition according to the invention, and/or with a virus according to the invention, and/or with a nucleic acid according to the invention, and/or with a vector according to the invention, and/or with a host cell according to the invention, and/or with a proteinaceous molecule or fragment thereof according to the invention, and/or with an antigen according to the invention, and/or with an antibody according to the invention, preferably wherein said mammal is a rabbit. In particular, a rabbit model is a model of choice for testing a pharmaceutical composition comprising a subunit peptide vaccine comprising part of the amino acid sequence of the spike protein as depicted in FIG. 17 (fragments of residues 358-588, comprising the essential receptor binding domain) which is used for the preparation of a therapeutic or prophylactic peptide for the preparation of a sub-unit vaccine. Vaccinating or immunizing rabbits with variant peptide vaccines and then challenging vaccinated and control rabbits with MERS-CoV that allows rapid infection and measurement of essential parameters such as development of (neutralizing) antibodies in experimental and control rabbits, development of protection against MERS-CoV infection or against MERS-CoV transmission allows for relatively inexpensive and rapid vaccine development studies, thereby allowing rapid vaccine development against human MERS-CoV infections. Attenuation of the virus by serial passage of MERS-CoV can now preferably achieved in rabbits by established methods developed for this purpose, including but not limited to the use of related viruses of other species, serial passages through other laboratory animals or/and tissue/cell cultures, serial passages through cell cultures at temperatures below 37 C (cold-adaption), site directed mutagenesis of molecular clones and exchange of genes or gene fragments between related viruses.

Now, as herein provided, a new human coronavirus was isolated from a patient with pneumonia. The virus was isolated from sputum of a male patient aged 60 years old presenting with pneumonia associated with acute renal failure. The virus grows readily on Vero cells and LLC-MK2 cells producing CPE in the form of rounding and syncytia formation and uses dipeptidyl peptidase 4 (DPP4) as a viral receptor for entry into cells establishing infection.

The clinical isolate was initially tested for influenza virus A, influenza virus B, parainfluenza virus, enterovirus and adenovirus, with negative results. Testing with a pancoronavirus RT-PCR yielded a band at a molecular weight appropriate for a coronavirus. The virus RNA was tested and it was confirmed to be a new member of the beta group of coronaviruses, closely related to bat coronaviruses. The invention relates to a new previously undescribed Coronavirus isolated from cases of unexplained disease in September 2012 and identified herein as belonging to a newly recognized and previously undescribed species of human Corona Virus (HCoV), herein identified as HCoV-SA1. In particular the nucleic acid and/or amino acid sequences of the HCoV-SA1 genome and sequences encoding (parts of) viral proteins are provided. Further, the invention relates to diagnostic means and methods, prophylactic means and methods and therapeutic means and methods to be employed in the diagnosis, prevention and/or treatment of disease, in particular of respiratory disease and/or renal failure (atypical pneumonia), in particular of mammals, more in particular in humans.

In particular diagnostic tests for example useful in PCR and serology with nucleic acids (primers) and antibodies and other reagents that are specifically targeted at the nucleic acid or amino acid sequences of the HCoV-SA1 genome are herein provided. The invention also provides vectors, such as bacterial and viral vectors based on nucleic acid or amino acid sequences of the HCoV-SA1 genome. In addition, the invention also provides antigenic polypeptides based amino acid sequences of the HCoV-SA1 genome are herein provided.

Also, the invention provides vaccines against HCoV-SA1 (based on nucleic acid or amino acid sequences or antigenic polypeptides of the HCoV-SA1 genome, and the invention provides use of antiviral drugs directed against nucleic acid or amino acid sequences or polypeptides of the HCoV-SA1 genome, as herein provided.

As for yet it is not known if there is a cure for the disease. Several antiviral therapies have been applied, but with various results. Also, for being able to prevent spread of the disease, it is of great importance to be able to recognize the disease in an early stage. Only then sufficient measures can be taken to isolate patients and initiate quarantine precautions. At this moment there is not yet a diagnostic tool in place. Thus, there is great need in developing diagnostic tools and therapies for this disease.

As further described in the detailed description herein, the isolated essentially mammalian positive-sense single stranded RNA virus classifiable as belonging to the Order: Nidovirales; Family: Coronaviridae; Subfamily: Coronavirinae; Genus: *Betacoronavirus*; and non-Lineage A, non-Lineage B or non-Lineage D, human *betacoronavirus* here provided was isolated from a patient with pneumonia. The virus was isolated from sputum of a male patient aged 60 years old presenting with pneumonia associated with acute renal failure. The virus grows readily on Vero cells and LLC-MK2 cells producing CPE in the form of rounding and syncytia formation. It was classified as an isolated essentially mammalian positive-sense single stranded RNA virus classifiable as belonging to the Order: Nidovirales; Family: Coronaviridae; Subfamily: Coronavirinae; Genus: *Betacoronavirus*; Lineage C human *betacoronavirus* by comparison of its RNA sequences. It is remarkable that now, at about 9 years after the isolation of the SARS-virus (also related to bat coronavirus) another *betacoronavirus* has been isolated from humans.

The invention also provides an isolated essentially mammalian positive-sense single stranded RNA virus comprising one or more of the nucleic acid or comprising one or more of amino acid sequences selected from FIG. 3 depicting the partial open reading frame of HCoV-SA1, FIG. 5 file N.rtf depicting the nucleocapsid (N) protein, FIG. 6 file M.rtf depicting the matrix (M) protein, FIG. 7 file E.rtf depicting the small envelope (E) protein, FIG. 8 file NS3d.rtf depicting the non-structural gene NS3d, FIG. 9 file NS3c.rtf depicting the non-structural gene NS3c, FIG. 10 file NS3b.rtf depicting the non-structural gene NS3b, FIG. 11 file NS3a.rtf depicting the non-structural gene NS3a, FIG. 12 file S.rtf depicting the spike surface glycoprotein (S), FIG. 13 file Orf1ab.rtf encoding many enzymatic products among which the replicase, FIG. 14 file HCoV-SA1.rtf depicting isolate HCoV-SA1 or FIG. 15 HCoV-SA1.rtf depicting its 3 translation frames, or comprising amino acid sequences having at least 75%, more preferably at least 80%, more preferably at least 85%, more preferably at least 90%, most preferably at least 95% identical with a nucleic acid or amino acid sequence depicted in said FIGS. 3, or 5 to 15.

In particular, the invention provides an isolated positive-sense single stranded RNA virus belonging to the Coronaviruses, genus *Betacoronavirus* having an amino acid sequence of its conserved replicase domain that is at least 75%, more preferably at least 80%, more preferably at least 85%, more preferably at least 90%, most preferably at least 95% identical with the amino acid sequence of the conserved replicase domain of an isolated essentially mammalian positive-sense single stranded RNA virus classifiable as belonging to the Order: Nidovirales; Family: Coronaviridae; Subfamily: Coronavirinae; Genus: *Betacoronavirus*; Lineage C isolatable from humans and comprising one or more of the sequences selected from any of FIGS. 3 or 5 to 15, preferably wherein said conserved replicase domain comprises ORF1ab, 90% identity being the species definition of the betacoronaviridae. Virus provided by the invention is herein also called HCoV-SA1 virus-like virus. The invention also provides an isolated positive-sense single stranded RNA virus belonging to the Coronaviruses, genus *Betacoronavirus* and identifiable as phylogenetically corresponding thereto by determining a nucleic acid or amino acid sequence of said virus and testing it in phylogenetic tree analyses wherein maximum likelihood trees are generated, preferably with 100 bootstraps and 3 jumbles, and finding it to be more closely phylogenetically corresponding to a virus isolate or nucleic acid having the sequences as depicted in any of FIGS. 3 or 5 to 15 than it is corresponding to a bat coronavirus virus HKU4 or HKU5.

The invention also provides an isolated positive-sense single stranded RNA virus belonging to the Coronaviruses, genus *Betacoronavirus* and identifiable as phylogenetically corresponding thereto by determining a nucleic acid or amino acid sequence of said virus and testing it in phylogenetic tree analyses wherein maximum likelihood trees are generated, preferably with 100 bootstraps and 3 jumbles, and finding it to be more closely phylogenetically corresponding to a virus isolate or nucleic acid having the sequences as depicted in any of the oligonucleotide or amino acid sequences submitted to GENBANK under accession JX869059 (http://www.ncbi.nlm.nih.gov/nuccore/JX869059) than it is corresponding to any of the oligonucleotide or amino acid sequences of bat coronavirus virus HKU4 or HKU5.

Although phylogenetic analyses provide a convenient method of identifying a virus as a *Betacoronavirus*; Lineage C virus several other possibly more straightforward albeit somewhat more coarse methods for identifying said virus or viral proteins or nucleic acids from said virus are herein also provided. As a rule of thumb a *Betacoronavirus*; Lineage C virus can be identified by the percentages of homology of the virus, proteins or nucleic acids to be identified in comparison with viral proteins or nucleic acids identified herein in or in Genbank accession JX869059 by sequence. It is generally known that virus species, especially RNA virus species, often constitute a quasi species wherein a cluster of said viruses displays heterogeneity among its members. Thus it is expected that each isolate may have a somewhat different percentage relationship with the sequences of the isolate as provided herein.

The invention in particular provides an isolated positive-sense single stranded RNA virus belonging to the Coronaviruses and identifiable as phylogenetically corresponding thereto by determining a nucleic acid sequence or amino acid sequence of said virus and testing it in phylogenetic tree analyses wherein maximum likelihood trees are generated and finding it to be more closely phylogenetically corresponding to a virus isolate or nucleic acid having the sequences as depicted in any of the oligonucleotide or amino acid sequences submitted to GENBANK under accession JX869059 (http://www.ncbi.nlm.nih.gov/nuccore/JX869059) than it is corresponding to any of the oligonucleotide or amino acid sequences of human coronavirus virus isolate HCoV-HKU1 or HCoV-OC43 or SARS-CoV.

The invention in particular provides an isolated positive-sense single stranded RNA virus belonging to the Coronaviruses and identifiable as phylogenetically corresponding thereto by determining a nucleic acid sequence or amino acid sequence of said virus and testing it in phylogenetic tree analyses wherein maximum likelihood trees are generated and finding it to be more closely phylogenetically corresponding to a virus isolate isolatable from humans having the sequences as depicted in any of FIGS. 3 or 5 to 15 than it is corresponding to a human coronavirus virus isolate HCoV-HKU1 or HCoV-OC43 or SARS-CoV.

The invention also provides a virus according to the invention wherein its positive-sense single stranded RNA nucleic acid sequence comprises an open reading frame (ORF) encoding a viral protein of said virus, preferably selected from the group of ORFs encoding the spike surface glycoprotein (S), the non-structural genes NS3a, NS3b, NS3c, NS3d, the small envelope (E) protein, the matrix (M) protein, and the nucleocapsid (N) protein. With the provision of the sequence information of this MERS-CoV, the invention provides diagnostic means and methods, prophylactic means and methods and therapeutic means and methods to be employed in the diagnosis, prevention and/or treatment of disease, in particular of respiratory disease (atypical pneumonia), in particular of mammals, more in particular in humans. In virology, it is most advisory that diagnosis, prophylaxis and/or treatment of a specific viral infection is performed with reagents that are most specific for said specific virus causing said infection. In this case this means that it is preferred that said diagnosis, prophylaxis and/or treatment of a *Betacoronavirus*; Lineage C virus infection is performed with reagents that are most specific for *Betacoronavirus*; Lineage C virus. This by no means however excludes the possibilities that less specific, but sufficiently cross-reactive reagents are used instead, for example because they are more easily available and sufficiently address the task at hand. The invention for example provides a method for virologically diagnosing a *Betacoronavirus*; Lineage C infection of an animal, in particular of a mammal, more in particular of a human being, comprising determining in a sample of said animal the presence of a viral isolate or component thereof by reacting said sample with a *Betacoronavirus*; Lineage C specific nucleic acid or antibody according to the invention, and a method for serologically diagnosing a *Betacoronavirus*; Lineage C infection of a mammal comprising determining in a sample of said mammal the presence of an antibody specifically directed against a *Betacoronavirus*; Lineage C virus or component thereof by reacting said sample with a *Betacoronavirus*; Lineage C MERS-CoV-specific proteinaceous molecule or fragment thereof or an antigen according to the invention. The invention also provides a diagnostic kit or other system for diagnosing a *Betacoronavirus*; Lineage C infection comprising a *Betacoronavirus*; Lineage C virus, a *Betacoronavirus*; Lineage C MERS-CoV-specific nucleic acid, proteinaceous molecule or fragment thereof, antigen and/or an antibody according to the invention, and preferably a means for detecting said *Betacoronavirus*; Lineage C virus, *Betacoronavirus*; Lineage C MERS-CoV-specific nucleic acid, proteinaceous molecule or fragment thereof, antigen and/or an antibody, said means for example comprising an excitable group such as a fluorophore or enzymatic detection system used in the art (examples of suitable diagnostic kit format comprise IF, ELISA, neutralization assay, RT-PCR assay). To determine whether an as yet unidentified virus component or synthetic analogue thereof such as nucleic acid, proteinaceous molecule or fragment thereof can be identified as *Betacoronavirus*; Lineage C-MERS-CoV-specific, it suffices to analyze the nucleic acid or amino acid sequence of said component, for example for a stretch of said nucleic acid or amino acid, preferably of at least 10, more preferably at least 25, more preferably at least 40 nucleotides or amino acids (respectively), by sequence homology comparison with the provided *Betacoronavirus*; Lineage C viral sequences and with known non-*Betacoronavirus*; Lineage C viral sequences (SARS is preferably used) using for example phylogenetic analyses as provided herein. Depending on the degree of relationship with said *Betacoronavirus*; Lineage C or non-*Betacoronavirus*; Lineage C viral sequences, (herein also called HCoV-SA1 virus-like virus sequences) the component or synthetic analogue can be identified. The invention also provides a virus according to the invention that is isolatable from a human with atypical pneumonia. Also, isolated or recombinant nucleic acid or MERS-CoV-specific fragments thereof are obtainable, derived or obtained from a virus according to the invention, as are a vector comprising a nucleic acid according to the invention, and a host cell comprising a nucleic acid or vector according to the invention.

The invention also provides an isolated or recombinant proteinaceous molecule or MERS-CoV-specific fragment thereof encoded by a nucleic acid according to the invention. In a preferred embodiment, the invention provides a proteinaceous molecule or MERS-CoV-specific viral protein or fragment thereof encoded by a nucleic acid according to the invention. Useful proteinaceous molecules are for example derived from any of the genes or genomic fragments derivable from a virus according to the invention. Such molecules, or antigenic fragments thereof, as provided herein, are for example useful in diagnostic methods or kits and in pharmaceutical compositions such as sub-unit vaccines and inhibitory peptides. Particularly useful is the viral polymerase protein, the spike protein, the nucleocapsid or antigenic fragments thereof for inclusion as antigen or subunit immunogen, but inactivated whole virus can also be used. Particularly useful are also those proteinaceous substances that are encoded by recombinant nucleic acid fragments that are identified for phylogenetic analyses, of course preferred are those that are within the preferred bounds and metes of ORFs useful in phylogenetic analyses, in particular for eliciting HCoV-SA1 virus-like virus specific antibodies, whether in vivo (e.g. for protective purposes or for providing diagnostic antibodies) or in vitro (e.g. by phage display technology or another technique useful for generating synthetic antibodies). Similarly, the invention provides an antigen comprising a proteinaceous molecule or MERS-CoV-specific fragment thereof according to the invention, or reactive with an antibody according to the invention.

Also provided herein are antibodies, be it natural polyclonal or monoclonal, or synthetic (e.g. (phage) library-derived binding molecules) antibodies that specifically react with an antigen comprising a proteinaceous molecule or HCoV-virus-like MERS-CoV-specific fragment thereof according to the invention. A person skilled in the art will be able to develop (monoclonal) antibodies using isolated virus material and/or recombinantly expressed viral proteins. Sui et al. (Proc. Natl. Acad. Sci. 101(8), 2536-2541, 2004) have transiently expressed fragments of the spike protein and found several antibodies through phage display methods. Such antibodies are also useful in a method for identifying a viral isolate as a HCoV-SA1 virus-like virus comprising reacting said viral isolate or a component thereof with an antibody as provided herein. This can for example be achieved by using purified or non-purified HCoV-SA1 virus-like virus or parts thereof (proteins, peptides) using ELISA, RIA, FACS or similar formats of antigen detection assays (Current Protocols in Immunology). Alternatively, infected cells or cell cultures may be used to identify viral antigens using classical immunofluorescence or immunohistochemical techniques. Specifically useful in this respect are antibodies raised against HCoV-SA1 virus-like virus proteins which are encoded by a nucleotide sequence comprising one or more of the fragments disclosed herein.

The invention also provides method for identifying a viral isolate as a *Betacoronavirus*, Lineage C comprising reacting said viral isolate or a component thereof with a nucleic acid according to the invention. Other methods for identifying a viral isolate as a HCOV-SA1 virus or MERS-CoV comprise reacting said viral isolate or a component thereof with a virus specific nucleic acid according to the invention In this way the invention provides a viral isolate identifiable with a method according to the invention as a mammalian virus taxonomically corresponding to a positive-sense single stranded RNA virus identifiable as likely belonging to the HCOV-SA1 or MERS-CoV virus genus within the family of Coronaviruses.

The method is useful in a method for virologically diagnosing a HCOV-SA1 or MERS-CoV virus infection of a mammal, said method for example comprising determining in a sample of said mammal the presence of a viral isolate or component thereof by reacting said sample with a nucleic acid or an antibody according to the invention.

Methods of the invention can in principle be performed by using any nucleic acid amplification method, such as the. Polymerase Chain Reaction (PCR; Mullis 1987, U.S. Pat. Nos. 4,683,195, 4,683,202, en 4,800,159) or by using amplification reactions such as Ligase Chain Reaction (LCR; Barany 1991, Proc. Natl. Acad. Sci. USA 88:189-193; EP Appl. No., 320,308), Self-Sustained Sequence Replication (3SR; Guatelli et al., 1990, Proc. Natl. Acad. Sci. USA 87:1874-1878), Strand Displacement Amplification (SDA; U.S. Pat. No. 5,270,184, en U.S. Pat. No. 5,455,166), Transcriptional Amplification System (TAS; Kwoh et al., Proc. Natl. Acad. Sci. USA 86:1173-1177), Q-Beta Replicase (Lizardi et al., 1988, Bio/Technology 6:1197), Rolling Circle Amplification (RCA; U.S. Pat. No. 5,871,921), Nucleic Acid Sequence Based Amplification (NASBA), Cleavage Fragment Length Polymorphism (U.S. Pat. No. 5,719,028), Isothermal and Chimeric Primer-initiated Amplification of Nucleic Acid (ICAN), Ramification-extension Amplification Method (RAM; U.S. Pat. Nos. 5,719,028 and 5,942,391) or other suitable methods for amplification of nucleic acids.

In order to amplify a nucleic acid with a small number of mismatches to one or more of the amplification primers, an amplification reaction may be performed under conditions of reduced stringency (e.g. a PCR amplification using an annealing temperature of 38.degree. C., or the presence of 3.5 mM MgCl2). The person skilled in the art will be able to select conditions of suitable stringency.

The primers herein are selected to be "substantially" complementary (i.e. at least 65%, more preferably at least 80% perfectly complementary) to their target regions present on the different strands of each specific sequence to be amplified. It is possible to use primer sequences containing e.g. inositol residues or ambiguous bases or even primers that contain one or more mismatches when compared to the target sequence. In general, sequences that exhibit at least 65%, more preferably at least 80% homology with the target DNA or RNA oligonucleotide sequences are considered suitable for use in a method of the present invention. Sequence mismatches are also not critical when using low stringency hybridization conditions.

The detection of the amplification products can in principle be accomplished by any suitable method known in the art. The detection fragments may be directly stained or labeled with radioactive labels, antibodies, luminescent dyes, fluorescent dyes, or enzyme reagents. Direct DNA stains include for example intercalating dyes such as acridine orange, ethidium bromide, ethidium monoazide or Hoechst dyes.

Alternatively, the DNA or RNA fragments may be detected by incorporation of labeled dNTP bases into the synthesized fragments. Detection labels which may be associated with nucleotide bases include e.g. fluorescein, cyanine dye or BrdUrd. When using a probe-based detection system, a suitable detection procedure for use in the present invention may for example comprise an enzyme immunoassay (EIA) format (Jacobs et al., 1997, J. Clin. Microbiol. 35, 791-795). For performing a detection by manner of the EIA procedure, either the forward or the reverse primer used in the amplification reaction may comprise a capturing group, such as a biotin group for immobilization of target DNA PCR amplicons on e.g. a streptavidin coated microtiter plate wells for subsequent EIA detection of target DNA-amplicons (see below). The skilled person will understand that other groups for immobilization of target DNA PCR amplicons in an EIA format may be employed.

Probes useful for the detection of the target DNA as disclosed herein preferably bind only to at least a part of the DNA sequence region as amplified by the DNA amplification procedure. Those of skill in the art can prepare suitable probes for detection based on the nucleotide sequence of the target DNA without undue experimentation as set out herein. Also the complementary nucleotide sequences, whether DNA or RNA or chemically synthesized analogs, of the target DNA may suitably be used as type-specific detection probes in a method of the invention, provided that such a complementary strand is amplified in the amplification reaction employed.

Suitable detection procedures for use herein may for example comprise immobilization of the amplicons and probing the DNA sequences thereof by e.g. southern blotting. Other formats may comprise an EIA format as described above. To facilitate the detection of binding, the specific amplicon detection probes may comprise a label moiety such as a fluorophore, a chromophore, an enzyme or a radio-label, so as to facilitate monitoring of binding of the probes to the reaction product of the amplification reaction. Such labels are well-known to those skilled in the art and include, for example, fluorescein isothiocyanate (FITC), beta-galactosidase, horseradish peroxidase, streptavidin, biotin, digoxigenin, 35S or 125I. Other examples will be apparent to those skilled in the art.

Detection may also be performed by a so called reverse line blot (RLB) assay, such as for instance described by Van den Brule et al. (2002, J. Clin. Microbiol. 40, 779-787). For this purpose RLB probes are preferably synthesized with a 5' amino group for subsequent immobilization on e.g. carboxyl-coated nylon membranes. The advantage of an RLB format is the ease of the system and its speed, thus allowing for high throughput sample processing.

The use of nucleic acid probes for the detection of RNA or DNA fragments is well known in the art. Mostly these procedures comprise the hybridization of the target nucleic acid with the probe followed by post-hybridization washings. Specificity is typically the function of post-hybridization washes, the critical factors being the ionic strength and temperature of the final wash solution. For nucleic acid hybrids, the Tm can be approximated from the equation of Meinkoth and Wahl, Anal. Biochem., 138: 267-284 (1984): Tm=81.5.degree. C.+16.6 (log M)+0.41 (% GC)-0.61 (% form)-500/L; where M is the molarity of monovalent cations, % GC is the percentage of guanosine and cytosine nucleotides in the nucleic acid, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1.degree. C. for each 1% of mismatching; thus, the hybridization and/or wash conditions can be adjusted to hybridize to sequences of the desired identity. For example, if sequences with >90% identity are sought, the Tm can be decreased 10.degree. C. Generally, stringent conditions are selected to be about 5.degree. C. lower than the thermal melting point (Tm) for the specific sequence and its complement at a defined ionic strength and pH. However, severely stringent conditions can utilize hybridization and/or wash at 1, 2, 3, or 4.degree. C. lower than the thermal melting point (Tm); moderately stringent conditions can utilize a hybridization and/or wash at 6, 7, 8, 9, or 10.degree. C. lower than the thermal melting point (Tm); low stringency conditions can utilize a hybridization and/or wash at 11, 12, 13, 14, 15, or 20.degree. C. lower than the thermal melting point (Tm). Using the equation, hybridization and wash compositions, and desired Tm, those of ordinary skill will understand that variations in the stringency of hybridization and/or wash solutions are inherently described. If the desired degree of mismatching results in a Tm of less than 45.degree. C. (aqueous solution) or 32.degree. C. (formamide solution) it is preferred to increase the SSC concentration so that a higher temperature can be used. An extensive guide to the hybridization of nucleic acids is found in Tijssen, Laboratory Techniques in Biochemistm and Molecular Biology—Hybridization with Nucleic Acid Probes, Part I, Chapter 2 "Overview of principles of hybridization and the strategy of nucleic acid probe assays", Elsevier. New York (1993); and Current Protocols in Molecular Biology, Chapter 2, Ausubel, et al., Eds., Greene Publishing and Wiley-Interscience, New York (1995).

In another aspect, the invention provides oligonucleotide probes for the generic detection of target RNA or DNA. The detection probes herein are selected to be "substantially" complementary to one of the strands of the double stranded nucleic acids generated by an amplification reaction of the invention. Preferably the probes are substantially complementary to the immobilizable, e.g. biotin labelled, antisense strands of the amplicons generated from the target RNA or DNA.

It is allowable for detection probes of the present invention to contain one or more mismatches to their target sequence. In general, sequences that exhibit at least 65%, more preferably at least 80% homology with the target oligonucleotide sequences are considered suitable for use in a method of the present invention. Antibodies, both monoclonal and polyclonal, can also be used for detection purpose in the present invention, for example, in immunoassays in which they can be utilized in liquid phase or bound to a solid phase carrier. In addition, the monoclonal antibodies in these immunoassays can be detectably labeled in various ways. A variety of immunoassay formats may be used to select antibodies specifically reactive with a particular protein (or other analyte). For example, solid-phase ELISA immunoassays are routinely used to select monoclonal antibodies specifically immunoreactive with a protein. See Harlow and Lane, Antibodies, A Laboratory Manual, Cold Spring Harbor Publications, New York (1988), for a description of immunoassay formats and conditions that can be used to determine selective binding. Examples of types of immunoassays that can utilize antibodies of the invention are competitive and non-competitive immunoassays in either a direct or indirect format. Examples of such immunoassays are the radioimmunoassay (RIA) and the sandwich (immunometric) assay. Detection of the antigens using the antibodies of the invention can be done utilizing immunoassays that are run in either the forward, reverse, or simultaneous modes, including immunohistochemical assays on physiological samples. Those of skill in the art will know, or can readily discern, other immunoassay formats Antibodies can be bound to many different carriers and used to detect the presence of the target molecules. Examples of well-known carriers include glass, polystyrene, polypropylene, polyethylene, dextran, nylon, amylases, natural and modified celluloses, polyacrylamides, agaroses and magnetite. The nature of the carrier can be either soluble or insoluble for purposes of the invention. Those skilled in the art will know of other suitable carriers for binding monoclonal antibodies, or will be able to ascertain such using routine experimentation.

The invention also provides a method for serologically diagnosing a MERS-CoV infection of a mammal comprising determining in a sample of said mammal the presence of an antibody specifically directed against a MERS-CoV or component thereof by reacting said sample with a proteinaceous molecule or fragment thereof or an antigen according to the invention Methods and means provided herein are particularly useful in a diagnostic kit for diagnosing a MERS-CoV infection, be it by virological or serological diagnosis. Such kits or assays may for example comprise a virus, a nucleic acid, a proteinaceous molecule or fragment thereof, an antigen and/or an antibody according to the invention.

Herewith, the invention provides a method for virologically diagnosing a *Betacoronavirus*, Lineage C infection of a mammal comprising determining in a sample of said mammal the presence of a viral isolate or component thereof by reacting said sample with a nucleic acid according to the invention or an antibody according to the invention or determining in a sample of said mammal the presence of an antibody specifically directed against a *Betacoronavirus*, Lineage C virus or component thereof by reacting said sample with a proteinaceous molecule or fragment thereof according to the invention or an antigen according to the invention.

The invention also provides diagnostic kit for diagnosing a *Betacoronavirus*, Lineage C infection comprising a virus according to the invention, a nucleic acid according to the invention, a proteinaceous molecule or fragment thereof according to the invention, an antigen according to the invention and/or an antibody according to the invention.

The invention also provides use of a MERS-CoV according to the invention, a nucleic acid according to the invention, a vector according to the invention, a host cell according to the invention, a proteinaceous molecule or fragment thereof according to the invention, an antigen according to the invention, or an antibody according to the invention for the production of a pharmaceutical composition, preferably for the production of a pharmaceutical composition for the treatment or prevention of a *Betacoronavirus*, Lineage C virus infection, preferably a human infection, or for the production of a pharmaceutical composition for the treatment or prevention of atypical pneumonia and/or renal failure, preferably wherein said atypical pneumonia and/or renal failure is a human disease.

The invention also provides pharmaceutical composition comprising a virus according to the invention, a nucleic acid according to the invention, a vector according to the invention, a host cell according to the invention, a proteinaceous molecule or fragment thereof according to the invention, an antigen according to the invention, or an antibody according to the invention.

A pharmaceutical composition comprising a virus, a nucleic acid, a proteinaceous molecule or fragment thereof, an antigen and/or an antibody according to the invention can for example be used in a method for the treatment or prevention of a MERS-CoV infection and/or a respiratory illness comprising providing an individual with a pharmaceutical composition according to the invention. This is most useful when said individual comprises a human. Antibodies against MERS-CoV proteins, especially against the spike protein of MERS-CoV, preferably against the amino acid sequence as depicted herein are also useful for prophylactic or therapeutic purposes, as passive vaccines. It is known from other coronaviruses that the spike protein is a very strong antigen and that antibodies against spike protein can be used in prophylactic and therapeutic vaccination.

The invention also provides method to obtain a modulator or an antiviral agent useful in the treatment of atypical pneumonia comprising establishing a cell culture or experimental animal comprising a virus according to the invention, treating said culture or animal with a candidate antiviral agent, and determining the effect of said modulator or agent on said virus or its infection of said culture or animal. An example of such an antiviral agent comprises a MERS-CoV virus-neutralizing antibody, or functional component thereof, as provided herein, but antiviral agents of other nature, such as ADA or adenosine are obtained as well. The invention also provides use of a modulator or an antiviral agent according to the invention for the preparation of a pharmaceutical composition, in particular for the preparation of a pharmaceutical composition for the treatment of atypical pneumonia, specifically when caused by a MERS-CoV infection, and provides a pharmaceutical composition comprising an antiviral agent according to the invention, useful in a method for the treatment or prevention of a MERS-CoV infection or atypical pneumonia, said method comprising providing an individual with such a pharmaceutical composition.

The invention also provides a method for the treatment or prevention of a *Betacoronavirus*, Lineage C virus infection or for the treatment or prevention of atypical pneumonia comprising providing an individual, preferably a human individual with a pharmaceutical composition according to the invention. In particular individual MERS-CoV virus-like polypeptide are provided herein as well, such as the viral replicase encoded by an RNA or DNA or cDNA sequence or fragments or homologues thereof, as depicted in FIG. 13. A viral spike protein encoded by an RNA or DNA or cDNA sequence or fragments or homologues thereof, as depicted in FIG. 12, a viral non-structural gene protein encoded by an RNA or DNA or cDNA sequence or fragments or homologues thereof, as depicted in any of FIG. 8, 9, 10 or 11, a small envelope (E) protein encoded by an RNA or DNA or cDNA sequence or fragments or homologues thereof, as depicted in FIG. 7, a matrix (M) protein encoded by an RNA or DNA or cDNA sequence or fragments or homologues thereof, as depicted in FIG. 6, a nucleocapsid (N) protein encoded by an RNA or DNA or cDNA sequence or fragments or homologues thereof, as depicted in FIG. 5, a nucleic acid sequence which comprises one or more of the sequences of HCoV-SA1 as depicted in FIGS. 3, or 5 to 15 or a nucleic acid sequence which can hybridize with any of these sequences under stringent conditions.

With the provision of the sequence information of this MERS virus, MERS-CoV, the invention provides diagnostic means and methods, prophylactic means and methods and therapeutic means and methods to be employed in the diagnosis, prevention and/or treatment of disease, in particular of respiratory disease (atypical pneumonia), in particular of mammals, more in particular in humans. In virology, it is most advisory that diagnosis, prophylaxis and/or treatment of a specific viral infection is performed with reagents that are most specific for said specific virus causing said infection. In this case this means that it is preferred that said diagnosis, prophylaxis and/or treatment of a MERS virus infection is performed with reagents that are most specific for MERS virus. This by no means however excludes the possibilities that less specific, but sufficiently cross-reactive reagents are used instead, for example because they are more easily available and sufficiently address the task at hand.

The invention for example provides a method for virologically diagnosing a MERS infection of an animal, in particular of a mammal, more in particular of a human being, comprising determining in a sample of said animal the presence of a viral isolate or component thereof by reacting said sample with a MERS specific nucleic acid or antibody according to the invention, and a method for serologically diagnosing a MERS infection of a mammal comprising determining in a sample of said mammal the presence of an antibody specifically directed against a MERS virus or component thereof by reacting said sample with a MERS-CoV-specific proteinaceous molecule or fragment thereof or an antigen according to the invention. Suitable MERS-CoV specific nucleic acid can for example is provided herein as well, such as the RNA or DNA or cDNA sequence or fragments or homologues thereof, as depicted in FIG. 13, or as depicted in FIG. 12, or in any of FIG. 8, 9, 10 or 11, in FIG. 7, in FIG. 6, in FIG. 5, a nucleic acid sequence which comprises one or more of the sequences of HCoV-SA1 or a MERS-CoV specific nucleic acid sequence which can hybridize with sequences in any of figures as depicted in FIGS. 3, or 5 to 15 under stringent conditions, or a MERS-CoV specific nucleic acid sequence, such as an RNA or a DNA or preferably a cDNA, which has at least 65%, preferably at least 75%, more preferably at least 85%, most preferably at least 95% homology or are substantially, at least 65%, preferably at least 75%, more preferably at least 85%, most preferably at least 95%, complementary with a nucleotide sequence as depicted in FIGS. 3, or 5 to 15. For MERS CoV nucleic acid diagnosis, short nucleotide stretches of 10 to 40, preferably 12 to 30, more preferably 15 to 25 nucleotides long, commonly called "primers" are provided herein that preferably are MERS-CoV specific or at least substantially complementary to MERS virus nucleic acid as depicted in FIG. 3, or 5-15 and have stretches of at least 10, preferably at least 12, more preferably at least 15, most preferably at least 18 or 19 nucleotides that are 100% complementary to at least a fragment of a nucleotide sequence as depicted in FIGS. 3, or 5 to 15. The term "nucleotide sequence homology" as used herein denotes the presence of homology between two (poly) nucleotides, such as a RNA or a DNA or a cDNA sequence. Polynucleotides have "homologous" sequences if the sequence of nucleotides in the two sequences is the same when aligned for maximum correspondence. Sequence comparison between two or more polynucleotides is generally performed by comparing portions of the two sequences over a comparison window to identify and compare local regions of sequence similarity. The comparison window is generally from about 20 to 200 contiguous nucleotides. The "percentage of sequence homology" for polynucleotides, such as 50, 60, 70, 80, 90, 95, 98, 99 or 100 percent sequence homology may be determined by comparing two optimally aligned sequences over a comparison window, wherein the portion of the polynucleotide sequence in the comparison window may include additions or deletions (i.e. gaps) as compared to the reference sequence (which does not comprise additions or deletions) for optimal alignment of the two sequences. Nucleotide or base G is homologous to G, C is homologous to C, A is homologous to A and nucleotides T or U are homologous to T or U, to calculate overall homology or complementarities between DNA and RNA. The percentage is calculated by: (a) determining the number of positions at which the identical nucleic acid base occurs in both sequences to yield the number of matched positions; (b) dividing the number of matched positions by the total number of positions in the window of comparison; and (c) multiplying the result by 100 to yield the percentage of sequence homology. Optimal alignment of sequences for comparison may be conducted by computerized implementations of known algorithms, or by inspection. Readily available sequence comparison and multiple sequence alignment algorithms are, respectively, the Basic Local Alignment Search Tool (BLAST) (Altschul, S. F. et al. 1990. J. Mol. Biol. 215:403; Altschul, S. F. et al. 1997. Nucleic Acid Res. 25:3389-3402) and ClustalW programs both available on the internet. Other suitable programs include GAP, BESTFIT and FASTA in the Wisconsin Genetics Software Package (Genetics Computer Group (GCG), Madison, Wis., USA).

As used herein, "substantially complementary" means that two nucleic acid sequences have at least about 65%, preferably about 70%, more preferably about 80%, even more preferably 90%, and most preferably about 98%, sequence complementarities to each other. This means that the primers and probes must exhibit sufficient complementarity to their template and target nucleic acid, respectively, to hybridize under stringent conditions. Therefore, the primer sequences as disclosed in this specification need not reflect the exact sequence of the binding region on the template and degenerate primers can be used. A substantially complementary primer sequence is one that has sufficient sequence complementarity to the amplification template to result in primer binding and second-strand synthesis.

The term "hybrid" refers to a double-stranded nucleic acid molecule, or duplex, formed by hydrogen bonding between complementary nucleotides. The terms "hybridize" or "anneal" refer to the process by which single strands of nucleic acid sequences form double-helical segments through hydrogen bonding between complementary nucleotides, according to a strict rule called base-pairing defined by the complementary structures of the nucleotides or bases (b). Typically, in two nucleic acid strands, nucleotide guanine (G) is complementary to nucleotide cytosine (C), G and C pair wise capable of forming three hydrogen bonds, and nucleotide adenine (A) is complementary to nucleotides thymine (T) or uracil (U), A and T or A and U pair wise capable of forming two hydrogen bonds, thus G pairs with C and A pairs with T or U. Conventionally, in depicting a nucleic acid sequence, T is commonly identified as uracil (U) to identify RNA (ribonucleic acid), and as thymine (T) when identifying DNA (deoxyribonucleic acid) or cDNA (complementary or copy DNA). A DNA polymerase is a cellular or viral polymerase enzyme that synthesizes DNA molecules from their nucleotide building blocks. DNA polymerases are essential for DNA replication, and usually function in pairs while copying one double-stranded DNA molecule into two double-stranded DNAs in a process termed DNA replication. RNA viruses commonly use an RNA-dependent RNA-polymerase to replicate their RNA. DNA can be used to produce RNA by the actions of a transcriptase; RNA can be used to produce DNA or cDNA by the actions of a reverse transcriptase. A transcriptase is a polymerase that catalyzes the formation of RNA from a DNA template in the process of transcription. Reverse transcriptase (RT) is a polymerase enzyme used to generate complementary DNA (cDNA) from an RNA template, a process termed reverse transcription.

The term "oligonucleotide" refers to a short sequence of nucleotide monomers (usually 6 to 100 nucleotides) joined by phosphorous linkages (e.g., phosphodiester, alkyl and aryl-phosphate, phosphorothioate), or non-phosphorous linkages (e.g., peptide, sulfamate and others). An oligonucleotide may contain modified nucleotides having modified bases (e.g., 5-methyl cytosine) and modified sugar groups (e.g., 2'-O-methyl ribosyl 2'-O-methoxyethyl ribosyl, 2'-fluoro ribosyl, 2'-amino ribosyl, and the like). Oligonucleotides may be naturally-occurring or synthetic molecules of double- and single-stranded DNA and double- and single-stranded RNA with circular, branched or linear shapes and optionally including domains capable of forming stable secondary structures (e.g., stem-and-loop and loop-stem-loop structures).

The term "primer" as used herein also refers to an oligonucleotide which is capable of annealing to the amplification target allowing a DNA polymerase to attach thereby serving as a point of initiation of DNA synthesis when placed under conditions in which synthesis of primer extension product which is complementary to a nucleic acid strand is induced, i.e., in the presence of nucleotides and an agent for polymerization such as DNA polymerase and at a suitable temperature and pH. The (amplification) primer is preferably single stranded for maximum efficiency in amplification. Preferably, the primer is an oligodeoxyribonucleotide. The primer must be sufficiently long to prime the synthesis of extension products in the presence of the agent for polymerization. The exact lengths of the primers will depend on many factors, including temperature and source of primer. A "pair of bi-directional primers" as used herein refers to one forward and one reverse primer as commonly used in the art of RNA or DNA amplification such as in PCR amplification.

The term "probe" refers to a single-stranded oligonucleotide sequence that will recognize and form a hydrogen-bonded duplex with a complementary sequence in a target nucleic acid sequence analyte or its cDNA derivative.

The terms "stringency" or "stringent hybridization conditions" refer to hybridization conditions that affect the stability of hybrids, e.g., temperature, salt concentration, pH, formamide concentration and the like. These conditions are empirically optimized to maximize specific binding and minimize non-specific binding of primer or probe to its target nucleic acid sequence. The terms as used include reference to conditions under which a probe or primer will hybridize to its target sequence, to a detectably greater degree than other sequences (e.g. at least 2-fold over background). Stringent conditions are sequence dependent and will be different in different circumstances. Longer sequences hybridize specifically at higher temperatures. Generally, stringent conditions are selected to be about 5.degree. C. lower than the thermal melting point (Tm) for the specific sequence at a defined ionic strength and pH. The Tm is the temperature (under defined ionic strength and pH) at which 50% of a complementary target sequence hybridizes to a perfectly matched probe or primer. Typically, stringent conditions will be those in which the salt concentration is less than about 1.0 M Na+ ion, typically about 0.01 to 1.0 M Na+ ion concentration (or other salts) at pH 7.0 to 8.3 and the temperature is at least about 30.degree. C. for short probes or primers (e.g. 10 to 50 nucleotides) and at least about 60.degree. C. for long probes or primers (e.g. greater than 50 nucleotides). Stringent conditions may also be achieved with the addition of destabilizing agents such as formamide. Exemplary low stringent conditions or "conditions of reduced stringency" include hybridization with a buffer solution of 30% formamide, 1 M NaCl, 1% SDS at 37.degree. C. and a wash in 2.times.SSC at 40.degree. C. Exemplary high stringency conditions include hybridization in 50% formamide, 1 M NaCl, 1% SDS at 37.degree. C., and a wash in 0.1.times.SSC at 60.degree. C. Hybridization procedures are well known in the art and are described in e.g. Ausubel et al, Current Protocols in Molecular Biology, John Wiley & Sons Inc., 1994.

The invention for example provides a method for virologically diagnosing a MERS infection of an animal, in particular of a mammal, more in particular of a human being, comprising determining in a sample of said animal the presence of a viral isolate or component thereof by reacting said sample with a MERS specific nucleic acid or antibody according to the invention, and a method for serologically diagnosing a MERS infection of a mammal comprising determining in a sample of said mammal the presence of an antibody specifically directed against a MERS virus or component thereof by reacting said sample with a MERS MERS-CoV-specific proteinaceous molecule or fragment thereof or an antigen according to the invention. Suitable MERS specific proteinaceous molecules or MERS virus specific fragment thereof is provided herein as well, such as the viral replicase encoded by an RNA or DNA or cDNA sequence or fragments or homologues thereof, as depicted in FIG. 13, a viral spike protein encoded by an RNA or DNA or cDNA sequence or fragments or homologues thereof, as depicted in FIG. 12, a viral non-structural gene protein encoded by an RNA or DNA or cDNA sequence or fragments or homologues thereof, as depicted in any of FIG. 8, 9, 10 or 11, a small envelope (E) protein encoded by an RNA or DNA or cDNA sequence or fragments or homologues thereof, as depicted in FIG. 7, a matrix (M) protein encoded by an RNA pr DNA sequence or fragments or homologues thereof, as depicted in FIG. 6, a nucleocapsid (N) protein encoded by an RNA or DNA or cDNA sequence or fragments or homologues thereof, as depicted in FIG. 5, a nucleic acid sequence which comprises one or more of the sequences of HCoV-SA1 as depicted in FIGS. 3, or 5 to 15 or a nucleic acid sequence which can hybridize with any of these sequences under stringent conditions.

Suitable MERS CoV specific antibodies directed against MERS CoV specific proteinaceous molecules or MERS CoV specific fragment thereof is provided herein as well, such as antibodies raised against a viral replicase encoded by an RNA sequence or fragments or homologues thereof, as depicted in FIG. 13, raised against a viral spike protein encoded by an RNA or DNA or cDNA sequence or fragments or homologues thereof, as depicted in FIG. 12, raised against a viral non-structural gene protein encoded by an RNA or DNA or cDNA sequence or fragments or homologues thereof, as depicted in any of FIG. 8, 9, 10 or 11, raised against a small envelope (E) protein encoded by an RNA or DNA or cDNA sequence or fragments or homologues thereof, as depicted in FIG. 7, raised against a matrix (M) protein encoded by an RNA or DNA or cDNA sequence or fragments or homologues thereof, as depicted in FIG. 6, raised against a nucleocapsid (N) protein encoded by an RNA or DNA or cDNA sequence or fragments or homologues thereof, as depicted in FIG. 5, a nucleic acid sequence which comprises one or more of the sequences of HCoV-SA1 as depicted in FIGS. 3, or 5 to 15 or a nucleic acid sequence which can hybridize with any of these sequences under stringent conditions.

The term "antibody" includes reference to antigen binding forms of antibodies (e. g., Fab, F(ab)2). The term "antibody" frequently refers to a polypeptide substantially encoded by an immunoglobulin gene or immunoglobulin genes, or fragments thereof which specifically bind and recognize an analyte (antigen). However, while various antibody fragments can be defined in terms of the digestion of an intact antibody, one of skill will appreciate that such fragments may be synthesized de novo either chemically or by utilizing recombinant DNA methodology. Thus, the term antibody, as used herein, also includes antibody fragments such as single chain Fv, chimeric antibodies (i. e., comprising constant and variable regions from different species), humanized antibodies (i. e., comprising a complementarity determining region (CDR) from a non-human source) and heteroconjugate antibodies (e. g., bispecific antibodies).

The invention also provides a diagnostic kit for diagnosing a MERS-CoV infection comprising a MERS Corona virus, or a MERS-CoV-specific nucleic acid, or a MERS-CoV-specific proteinaceous molecule or fragment thereof, a MERS-CoV-specific antigen and/or an a MERS-CoV-specific antibody according to the invention, and preferably a means for detecting said MERS-CoV, MERS-CoV-specific nucleic acid, said proteinaceous molecule or fragment thereof, said antigen and/or said antibody, said means for example comprising an excitable group such as a fluorophore or enzymatic detection system used in the art (examples of suitable diagnostic kit format comprise IF, ELISA, neutralization assay, RT-PCR assay). To determine whether an as yet unidentified virus component or synthetic analogue thereof such as nucleic acid, proteinaceous molecule or fragment thereof can be identified as MERS-CoV-specific, it suffices to analyze the nucleic acid or amino acid sequence of said component, for example for a stretch of said nucleic acid or amino acid, preferably of at least 10, more preferably at least 25, more preferably at least 40 nucleotides or amino acids (respectively), by sequence homology comparison with the herein provided MERS viral sequences and with known non-MERS viral sequences (HUK4 or HUK5 are preferably used) using for example phylogenetic analyses as provided herein. Depending on the degree of relationship with said MERS or non-MERS viral sequences, the component or synthetic analogue can be identified.

The sequence of the first isolate of MERS-CoV is also deposited in Genbank under:
LOCUS JX869059 30119 bp RNA linear VRL 4 Dec. 2012
DEFINITION Human *betacoronavirus* 2c EMC/2012, complete genome.
ACCESSION JX869059
VERSION JX869059.2 GI:409052551
KEYWORDS
SOURCE Human *betacoronavirus* 2c EMC/2012
ORGANISM Human *betacoronavirus* 2c EMC/2012
Viruses; ssRNA positive-strand viruses, no DNA stage; Nidovirales; Coronaviridae; Coronavirinae; Betacoronavirus; unclassified *Betacoronavirus*.
REFERENCE 1 (bases 1 to 30119)
AUTHORS van Boheemen, S., de Graaf, M., Lauber, C., Bestebroer, T. M., Raj, V. S., Zaki, A. M., Osterhaus, A. D., Haagmans, B. L., Gorbalenya, A. E., Snijder, E. J. and Fouchier, R. A.
TITLE Genomic characterization of a newly discovered coronavirus associated with acute respiratory distress syndrome in humans
JOURNAL MBio 3 (6), e00473-12 (2012)
PUBMED 23170002

Figure 16A:
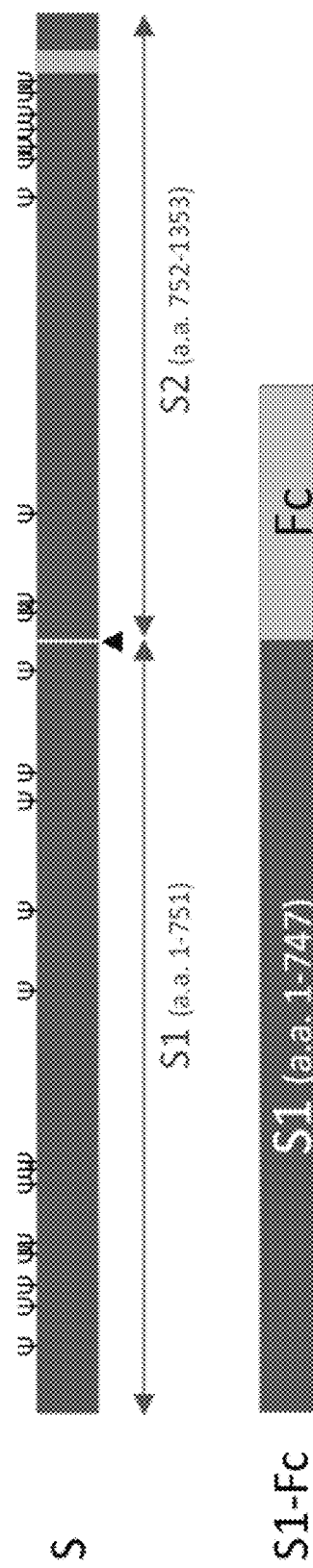
Figure 32:
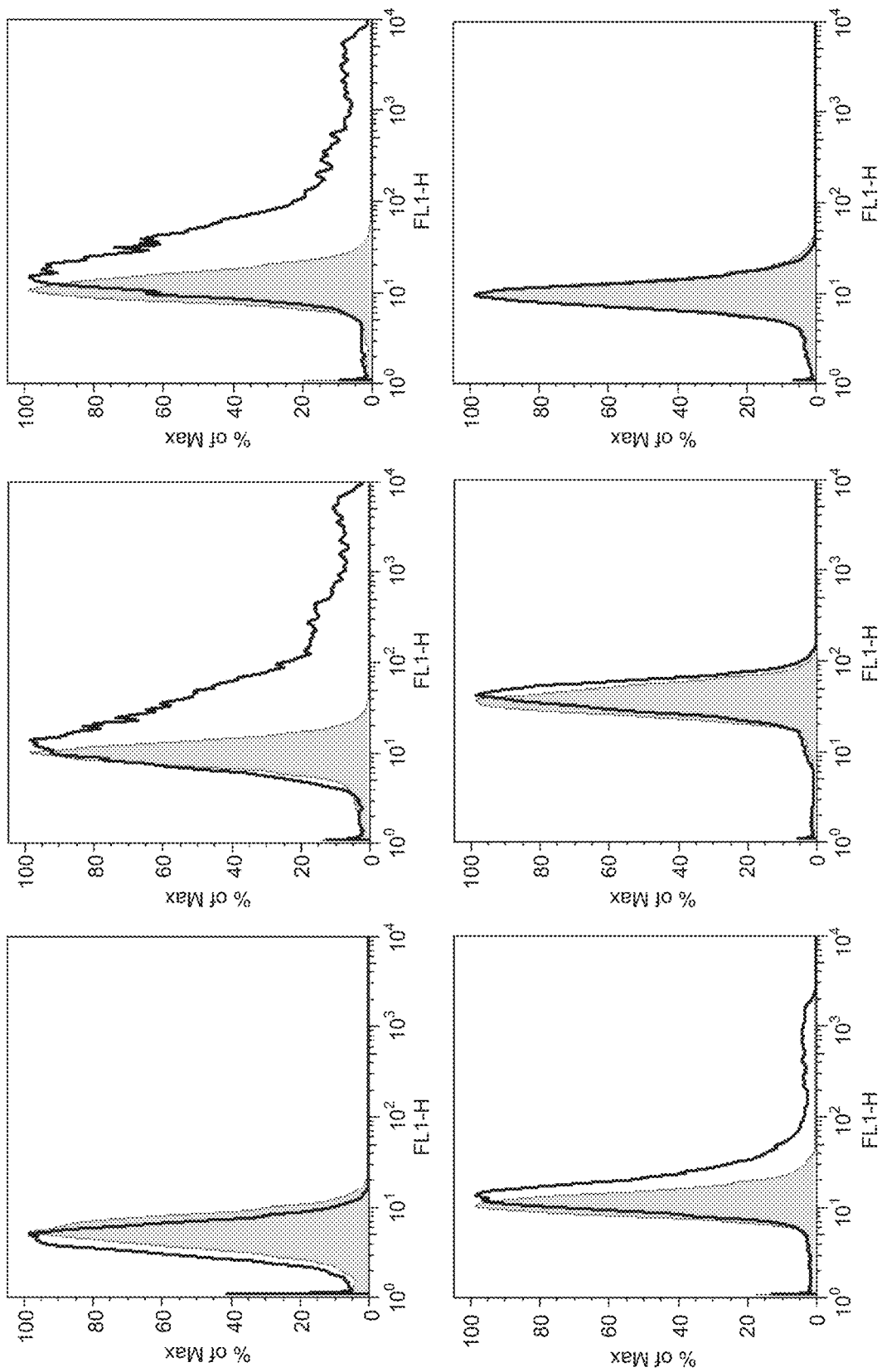

The present invention in particular also relates to the spike (S) protein of a Coronavirus that utilizes DPP4 as a virus receptor and fragments thereof as for example depicted in FIGS. 16, 17 and 32.

The invention in a further embodiment also provides a proteinaceous substance comprising, preferably having been provided, with at least a fragment of a viral protein, preferably an isolated fragment, herein a fragment obtained by recombinant means is preferably used as the probe protein, but a synthetic peptide obtained by chemical peptide synthesis can also be used, also called a first fragment and having also been provided with at least a fragment of an N terminal dipeptidyl peptidase, herein surprisingly found to be the target protein specifically reacting with the used viral probe and herein also called a second fragment.

In describing a proteinaceous substance herein, reference is made to protein containing material, such as an organism or a part thereof, microbial organism, virus, tissue, cell, cell culture, cell culture precipitate, cell culture supernatant, cell content such as cytoplasm, nucleoplasm, nuclei, nucleoli, cell organelles, mitochondria, ribosome, tubuli, plasma, blood, serum, lymph, drainage fluid, and to a protein containing preparation, such as a buffer, dilution, precipitate, extraction, pull down sample, test sample, spray, chromatographic sample, or a crystal.

Surprisingly, in pull down binding experiments with a fragment of a newly discovered coronavirus, it was found that the first isolated fragment, comprising an ectodomain of the spike protein of the virus, bound to at least the ectodomain of a prolyl peptidase, an N terminal dipeptidyl peptidase, the identity of which was confirmed by mass spectrometric analyses of tryptic peptide digests. No binding interaction between an N terminal dipeptidyl peptidase and a viral protein has been found before, in particular, not wherein the peptidase is acting as a receptor for the virus, allowing viral entry and replication in a cell. Blocking DPP4 with specific anti DPP4 antibodies indeed abolished viral infection.

The invention also relates to ten protease families that are unique to higher organisms (16 protease families can be identified in the genomes of all forms of cellular life). Within this core group of ten protease families, a multitude of proteases evolved to yield intra and extra cellular processes. Dipeptidyl peptidase 4 (DPP4; Dipeptidyl Peptidase IV (DPPIV)) is a member of this large family of proteases (peptidases). DPP4 is a serine protease of family S9. DPP4 is a 240 kDa homodimeric, multi functional type II membrane bound glycoprotein, widely distributed in all mammalian tissues, but highly expressed in kidney, liver and endothelium. DPPIV is also known as DPP4, CD26, adenosine deaminase complexing protein 2 or adenosine deaminase binding protein (ADAbp). DPP4 consists of a short cytoplasmic domain of six amino acids, followed by a hydrophobic transmembrane domain (amino acids 7 28) and an extracellular (ectodomain) sequence of 739 amino acids. DPP4 is a highly specific aminopeptidase and releases dipeptides from the amino terminus of peptides with a Pro or Ala in the penultimate position. N terminal degradation of the substrate peptides may result in the activation, inactivation or modulation of their activity. Besides its well known exopeptidase activity, DPPIV also exhibits endopeptidase activity toward denatured collagen. Expression of DPPIV is associated with cell adhesion and is a co stimulant during T cell activation and proliferation.

DPPIV (DPP4, CD26) is a member of the class of proteases known as prolyl peptidases, which cleave proteins after proline residues. DPPIV, a serine dipeptidyl peptidase, cleaves the N terminal X Ala or X Pro from target polypeptides, such as chemokines (e.g., CXCL11) and peptide hormones (e.g., GLP 1, PACAP, VIP, BNP). DPPIV possesses a transmembrane region and a very short cytoplasmic domain, but is often cleaved and released as a soluble, circulating fragment. Serine proteases are grouped into 43 families. Protease family S9 is divided into four subfamilies: S9A (type prolyl oligopeptidase), S9B (DPP4), S9C (acylaminoacyl peptidase), and S9D (glutamyl endopeptidase).

In humans, members of the subfamily S9B include DPP4, fibroblast activation protein alpha (FAPα), dipeptidyl peptidase 8 (DPP8), and dipeptidyl peptidase 9 (DPP9). DPP4 is also known as adenosine deaminase binding protein (ADBP) or T cell activation antigen CD26. DPP4 is a serine exopeptidase that catalyzes the release of an N terminal dipeptide provided that the next to last residue is proline, hydroxyproline, dehydroproline or alanine.

Only oligopeptides in the trans conformation are able to bind to the active site of DPP4. It also has non peptidase functions: through its interaction with adenosine deaminase (ADA) and extracellular matrix components, it influences T cell activation and proliferation. It is thought to play roles in diabetes, cancer, and autoimmune diseases, making it a target for drug discovery. In particular, cleavage of GLP 1 (7 36) amide, an incretin hormone that stimulates insulin biosynthesis and secretion, into GLP 1 (9 36) amide by DPPIV reverses the glucoregulatory actions of GLP 1. Therefore, DPPIV inhibitors are attractive targets for stimulating insulin production in type II diabetes. Several specific DPPIV inhibitors have been approved by the FDA for type II diabetes.

The invention also provides a proteinaceous substance comprising, preferably having been provided with, an isolated first fragment of a viral protein and an isolated second fragment of an N terminal dipeptidyl peptidase protein. Repeating binding experiments with a recombinant, isolated, fragment of the peptidase indeed confirmed the identification of the peptidase as a receptor of the MERS CoV and of the HKU4 CoV, allowing binding of the virus to a mammalian cell (both bat DPP4 as well as human DPP4 were tested), and entry of the MERS CoV leading to abundant replication of that virus in COS7 cells having been provided with the isolated second fragment, whereas COS7 cells not having been provided with the second fragment remain essentially impervious for infection with the virus.

In a further embodiment, the invention thus provides a proteinaceous substance having been provided with the isolated first probing fragment, preferably a recombinant fragment, of a viral protein and an isolated second fragment, preferably recombinant fragment, of an N terminal dipeptidyl peptidase protein, establishing a probe identified target pair of binding proteins that may be used for binding or affinity studies and preferably also for methods to identify modulators of the interaction of the binding pair.

In a further embodiment, the invention provides a proteinaceous substance comprising, preferably having been provided with, a first fragment of a viral protein and an isolated second, preferably recombinant, fragment of an N terminal dipeptidyl peptidase protein (a fragment obtained by regular peptide synthesis may also be use as first or second fragment). Such a substance provided, in particular, is useful in identifying further binding sites of viral proteins, and fragments thereof, e.g., for narrowing down of specific binding site sequences.

In a preferred embodiment, the invention provides a proteinaceous substance having been provided with at least a fragment of a viral protein, preferably an isolated fragment, wherein the viral protein comprises an ectodomain of a spike protein or of an envelope protein, the ectodomain being the most preferred site for virus cell receptor interaction.

It is preferred that a substance according to the invention comprises coronaviral protein, preferably wherein the coronaviral protein is derived from the HCoV EMC 1 virus, preferably wherein the first fragment is derived from the S1 region of a coronavirus. In a particular embodiment, the first fragment comprises residues 1 747 of the viral spike protein of HCoV EMC 1 as depicted in FIG. 16.

The invention also provides a substance according to the invention wherein the first fragment comprises, preferably consists of, at least 10, preferably of at least 50, preferably of at least 100 residues derived from the S1 region of a coronavirus. Using smaller fragments from distinct locations in the viral sequence allows for further identifying minimal essential sequences, and thereby narrowing down on the binding site, necessary for binding with the peptidase.

In particular, a substance according to the invention is provided wherein the first fragment is derived from the S1 region of a coronavirus, for example, comprising residues 1 747 as depicted in 161. Examples of such selected fragments are also found in FIG. 17, preferably the invention provides a substance with a first fragment consisting of residues 1 357, or of residues 1 588, or of residues 358 588, or of residues 358 747, or of residues 588 747 as depicted in FIG.

16 or FIG. 17, or of residues 363 593 of the spike protein of HKU4 CoV as shown in FIG. 17.

Even more in particular, a substance according to the invention is provided wherein the first fragment is derived from the S1 region of a coronavirus, which fragment then is subjected to limited proteolysis after which the protease resistant domains are identified by MS, and the interaction between probe and target is studied further.

The invention also provides a substance according to the invention wherein the peptidase belongs to protease family S9, preferably subfamily S9B, preferably wherein the peptidase is a dipeptidyl peptidase 4 (DPP4), preferably human DPP4, and preferably wherein the fragment is derived from the ectodomain of dipeptidyl peptidase. In one embodiment, it is provided that the second fragment comprises residues 39 766 of human DPP4 as depicted in FIG. 18.

The invention also provides a substance according to the invention wherein the second fragment comprises, preferably consists of, at least 10, preferably of at least 50, preferably of at least 100 residues derived from the ectodomain of dipeptidyl peptidase, such as wherein the second fragment is derived from the ectodomain of human DDP4 comprising residues 39 766 as depicted in FIG. 18.

Examples of such selected fragments are also found in FIG. 3, preferably the invention provides a substance with a second fragment consisting of residues 1 6, or of residues 1 28, or of residues 29 38, or of residues 39 51, or of residues 506 766 as depicted in FIG. 18.

Even more in particular, a substance according to the invention is provided wherein the second fragment is derived from the ectodomain of a peptidase, which fragment is then subjected to limited proteolysis after which the protease resistant domains are identified by MS, and the interaction between probe and target is studied further.

The invention also provides a substance according to the invention wherein at least one of the isolated fragments has been provided with an affinity tag, preferably a tag having affinity to binding with Protein A or a tag having affinity for binding with streptavidin.

The invention also provides a substance according to the invention consisting essentially of an isolated first fragment of a viral protein and an isolated second fragment of an N terminal peptidase protein. In a preferred embodiment, the viral protein is a coronaviral protein, preferably derived from a virus capable of infecting a human cell, whereas the peptidase protein is a DPP4 protein, preferably a human DPP4 protein.

Furthermore, a substance according to the invention is herein provided that has been subjected to crystallization, preferably a substance comprising a crystal consisting essentially of an isolated first fragment of a viral protein and an isolated second fragment of an N terminal peptidase protein. In a preferred embodiment, the viral protein is a coronaviral protein, preferably derived from a virus capable of infecting a human cell, whereas the peptidase protein is a DPP4 protein, preferably a human DPP4 protein.

The invention also provides a method for identifying a binding site comprising subjecting a crystal consisting essentially of an isolated first fragment of a viral protein and an isolated second fragment of an N terminal peptidase protein to X ray or neutron diffraction analysis. This is, for example, in order to determine the three dimensional structure of fragments of DPPIV and coronaviral protein and, in particular, to assist in the identification of its active site where fragments may bind. Knowledge of the binding site region allows rational design and construction of ligands including inhibitors. Crystallization and structural determination of fragments of DPPIV mutants and/or viral protein mutants having altered bioactivity allows the evaluation of whether such changes are caused by general structure deformation or by side chain alterations at the substitution site.

The invention also provides a container with a substance according to the invention, such as container provided with a virus according to the invention, and/or a nucleic acid according to the invention, and/or a vector according to the invention, and/or a host cell according to the invention, and/or a proteinaceous molecule according the invention, and/or an antigen according to the invention, and/or or an antibody according to the invention and/or a pharmaceutical composition according to the invention. In describing a container herein, reference is made to a test device, test tube (commonly Eppendorf tubes are used), test vessel, pipette, pipette tip, reaction device, cell culture vessel, cell culture well, reaction chamber, cover slip, crystallization chamber, crystallization device, crystallization well, microplate well, crystallization plate well, gel, column wherein, on or under a proteinaceous substance according to the invention may be placed or contained or that are useful for storing, shipping, testing or handling a proteinaceous substance provided herein.

The invention also provides a method of identifying a candidate modulator as an agent that modulates the function of a dipeptidyl peptidase, the method comprising providing a substance with a first and a second fragment according to the invention in the presence and absence of the candidate modulator under conditions permitting binding of the first fragment with the second fragment. Measuring binding of the first fragment to the second fragment, wherein a decrease or increase in binding in the presence of the candidate modulator, relative to binding in the absence of the candidate modulator, identifies the candidate modulator as an agent that modulates the function of a dipeptidyl peptidase.

The invention further provides a method of detecting, in a sample, the presence of an agent that modulates the function of a dipeptidyl peptidase, said method comprising providing a substance with a first and a second fragment according to the invention in the presence and absence of said sample under conditions permitting binding of said first fragment with said second fragment. Measuring binding of said first fragment to said second fragment, wherein a decrease or increase in binding in the presence of said sample, relative to binding in the absence of said sample, identifies said sample as comprising an agent that modulates the function of a dipeptidyl peptidase.

The invention further provides a method of identifying a candidate modulator as an agent that modulates the function of a dipeptidyl peptidase, said method comprising providing a substance with a first and a second fragment according to the invention in the presence and absence of said candidate modulator under conditions permitting determining enzymatic activity of a peptidase. Measuring enzymatic activity of a peptidase, wherein a decrease or increase in enzymatic in the presence of said candidate modulator, relative to binding in the absence of said candidate modulator, identifies said candidate modulator as an agent that modulates the function of a dipeptidyl peptidase.

The invention further provides a method of detecting, in a sample, the presence of an agent that modulates the function of a dipeptidyl peptidase, said method comprising providing a substance with a first and a second fragment according to the invention in the presence and absence of said sample under conditions permitting determining enzymatic activity of a peptidase. Measuring enzymatic activity of a peptidase, wherein a decrease or increase in enzymatic in the presence of said sample, relative to binding in the absence of said sample, identifies said sample as comprising an agent that modulates the function of a dipeptidyl peptidase.

In a preferred embodiment, the invention further provides a method of identifying a candidate modulator as an that modulates the function of a dipeptidyl peptidase or a provides a method of detecting, in a sample, the presence of an agent that modulates the function of a dipeptidyl peptidase wherein said first fragment and/or said second fragment is detectably labeled, preferably wherein said first fragment and/or said second fragment is detectably labeled with a moiety selected from the group consisting of a radioisotope, a fluorophore, a quencher of fluorescence, an enzyme, and an affinity tag. It is also provided that said substance comprises a cell expressing said first fragment and/or said second fragment.

The invention also provides use of a substance, a container or a method according to the invention for identifying an agent that modulates the function of a peptidase or a viral protein, use of an isolated fragment of a viral protein as an agent that modulates the function of an N-terminal dipeptidyl peptidase, and use of an isolated fragment of a N-terminal dipeptidyl peptidase as an agent that modulates the function of a viral protein.

The invention further provides use of an inhibitor, preferably adenosine, or a functional equivalent thereof, of N-terminal dipeptidyl peptidase cell-surface expression on a cell, as a modulator or antiviral agent for inhibition of replication of a virus in said cell, in particular wherein said peptidase is DPP4, preferably human DPP4, preferably wherein said virus is a Coronavirus.

Also, the invention provides vaccines against HCoV SA1 (based on nucleic acid or amino acid sequences or antigenic polypeptides of the HCoV SA1 genome, and the invention provides use of antiviral drugs directed against nucleic acid or amino acid sequences or polypeptides of the HCoV SA1 (herein also called MERS HCoV) genome, as herein provided. At this time, it is not known if there is a cure for the disease. Several antiviral therapies have been applied, but with various results. Also, for being able to prevent spread of the disease, it is of great importance to be able to recognize the disease in an early stage. Only then, sufficient measures can be taken to isolate patients and initiate quarantine precautions.

The invention also provides an isolated or recombinant proteinaceous molecule or MERS-CoV-specific fragment thereof encoded by a nucleic acid according to the invention. In a preferred embodiment, the invention provides a proteinaceous molecule or corona MERS-CoV-specific viral protein or fragment thereof encoded by a nucleic acid according to the invention. Useful proteinaceous molecules are, for example, derived from any of the genes or genomic fragments derivable from a virus according to the invention. Such molecules or antigenic fragments thereof, as provided herein, are, for example, useful in diagnostic methods or kits and in pharmaceutical compositions such as sub unit vaccines and inhibitory peptides. Particularly useful is the viral polymerase protein, the spike protein, the nucleocapsid or antigenic fragments thereof for inclusion as antigen or subunit immunogen, but inactivated whole virus can also be used.

Particularly useful are also those proteinaceous substances that are encoded by recombinant nucleic acid fragments that are identified for phylogenetic analyses, of course, preferred are those that are within the preferred bounds and metes of ORFs useful in phylogenetic analyses, in particular, for eliciting MERS-CoV-specific antibodies, whether in vivo (e.g., for protective purposes or for providing diagnostic antibodies) or in vitro (e.g., by phage display technology or another technique useful for generating synthetic antibodies). Similarly, the invention provides an antigen comprising a proteinaceous molecule or MERS-CoV-specific fragment thereof according to the invention, or reactive with an antibody according to the invention.

Also provided herein are antibodies, be it natural polyclonal or monoclonal, or synthetic (e.g., (phage) library derived binding molecules) antibodies that specifically react with an antigen comprising a proteinaceous molecule or HCoV virus like MERS-CoV-specific fragment thereof according to the invention. A person skilled in the art will be able to develop (monoclonal) antibodies using isolated virus material and/or recombinantly expressed viral proteins. Sui et al. (Proc. Natl. Acad. Sci. 101(8):2536 2541, 2004) have transiently expressed fragments of the spike protein and found several antibodies through phage display methods. Such antibodies are also useful in a method for identifying a viral isolate as a MERS HCoV virus like virus comprising reacting the viral isolate or a component thereof with an antibody as provided herein. This can, for example, be achieved by using purified or non purified HCoV SA1 virus like virus or parts thereof (proteins, peptides) using ELISA, RIA, FACS or similar formats of antigen detection assays (Current Protocols in Immunology). Alternatively, infected cells or cell cultures may be used to identify viral antigens using classical immunofluorescence or immunohistochemical techniques. Specifically useful in this respect are antibodies raised against MERS HCoV virus like virus proteins that are encoded by a nucleotide sequence comprising one or more of the fragments disclosed herein.

In particular, MERS HCoV virus like polypeptide or fragments are provided herein as well, such as those provided in FIG. 16 or FIG. 17, in particular, fragments derived from a viral spike protein, preferably the S1 spike protein, in particular, fragments of the S1 protein, such as fragment 1 357, or fragment 358 747, or fragment 358-588, or homologues thereof, as depicted in FIG. 17, or fragment 363 593 of the spike protein of HKU4 Co, as shown in FIG. 32, are herein provided. Also, isolated or recombinant nucleic acid, or MERS-CoV-specific fragments thereof that are obtainable from a MERS HCoV virus are provided, such as nucleic acid encoding fragments of the S1 protein, such as fragment 1 357, or fragment 358 747, or fragment 358-588, or homologues thereof, as depicted in FIG. 17, as are a vector or plasmid comprising a nucleic acid according to the invention, and a cell, such as host cell, such as a 293T cell comprising a nucleic acid or vector (vector comprising plasmid herein) according to the invention.

The invention also provides an isolated or recombinant proteinaceous molecule or MERS-CoV-specific fragment thereof encoded by a nucleic acid according to the invention. In a preferred embodiment, the invention provides a proteinaceous molecule or MERS-CoV-specific viral protein or fragment thereof encoded by a nucleic acid according to the invention for use in a vaccine. Useful proteinaceous molecules are, for example, derived from any of the genes or genomic fragments derivable from a virus or fragment thereof according to the invention. Such molecules, or antigenic fragments thereof, as provided herein, are, for example, useful in diagnostic methods or kits and in pharmaceutical compositions such as sub unit vaccines and inhibitory peptides.

Particularly useful are the viral polymerase protein, the spike protein, the nucleocapsid or antigenic fragments thereof for inclusion in a vaccine as antigen or subunit immunogen, in particular, fragments derived from a viral spike protein, preferably the S1 spike protein is provide for use in a vaccine, in particular, fragments of the S1 protein, such as fragment 1 357, or fragment 358 747, or fragment 358-588, or homologues thereof, as depicted in FIG. 17 that were are shown herein to interact with DPP4 and to elicit neutralizing antibodies, or fragment 363 593 of the spike protein of HKU4 Co remarkably interacting with DPP4 as well, as shown in FIG. 32, but inactivated whole virus can also be used in a vaccine. Particularly useful are those proteinaceous substances that are encoded by recombinant nucleic acid fragments that are identified for phylogenetic analyses, of course, preferred are those that are within the preferred bounds and metes of ORFs useful in phylogenetic analyses, in particular, for eliciting MERS-CoV specific antibodies, whether in vivo (e.g., for protective purposes such as by vaccination or for providing diagnostic antibodies) or in vitro (e.g., by phage display technology or another technique useful for generating synthetic antibodies). Similarly, the invention provides an antigen comprising a proteinaceous molecule or MERS-CoV-specific fragment thereof according to the invention, reactive with an antibody according to the invention. Such an antibody as herein provided is preferably reactive with a fragment of the S1 protein, such as fragment 1 357, or fragment 358 747, preferably fragment 358-588, of MERS-CoV or homologues thereof, as depicted in FIGS. 17 and 32.

The invention also provides a pharmaceutical composition comprising a virus, a nucleic acid, a proteinaceous molecule or fragment thereof, preferably consisting of the amino acid sequence 358 588 of MERS CoV or of the sequence 363 593 of the spike protein of HKU4 CoV, more preferably having at least a part of the amino acid sequence 358 588 of MERS CoV or of the sequence 363 593 of the spike protein of HKU4 CoV as depicted herein.

An antigen and/or an antibody according to the invention can, for example, be used in a method for the treatment or prevention of a MERS HCoV infection and/or a respiratory illness comprising providing an individual with a pharmaceutical composition according to the invention, for example as a vaccination against useful against infection with corona viruses that use DPP4 as a virus receptor such as seen with MERS-CoV infection or HKU4-CoV infection. This is most useful when the individual comprises a human. Antibodies directed against MERS HCoV proteins, especially against the spike protein of MERS HCoV, preferably against the amino acid sequence 358 588 or the sequence 363 593 of the spike protein of HKU4 CoV, or more preferably directed against at least a part of the amino acid sequence 358 588 of MERS CoV or of the sequence 363 593 of the spike protein of HKU4 Co are herein also provided and are useful for prophylactic or therapeutic purposes, as passive vaccines or part of an anti-serum useful to protect against infection with corona viruses that use DPP4 as a virus receptor, such as MERS-CoV or HKU4-CoV. It is known from other coronaviruses that the spike protein is a very strong antigen and that antibodies against spike protein can be used in prophylactic and therapeutic treatment.

The invention also proteinaceous substance having been provided with a isolated or recombinant proteinaceous molecule or MERS-CoV-specific fragment thereof encoded by a nucleic acid according to the invention and additionally comprising at least a fragment of an N-terminal dipeptidyl peptidase protein. In a preferred embodiment, the invention provides a proteinaceous substance having been provided with a proteinaceous molecule or MERS-CoV-specific viral protein or fragment thereof encoded by a nucleic acid according to the invention. Useful proteinaceous molecules are for example derived from any of the genes or genomic fragments or open reading frames (ORFs) derivable from a virus according to the invention. Particularly useful are the viral polymerase protein, the spike protein, the nucleocapsid or antigenic fragments thereof, but inactivated whole virus can also be used. Particularly useful are also those proteinaceous substances that are encoded by recombinant nucleic acid fragments that are identified for phylogenetic analyses, of course preferred are those that are within the preferred bounds and metes of ORFs useful in phylogenetic analyses, in particular for eliciting MERS-CoV specific antibodies, The invention also proteinaceous substance having been provided with a isolated or recombinant proteinaceous molecule according to the invention or MERS-CoV-specific fragment thereof wherein said proteinaceous molecule comprises an ectodomain of a spike protein, said ectodomain preferably derived from the S1 region of a coronavirus. In another preferred embodiment, the invention also proteinaceous substance having been provided with a isolated or recombinant proteinaceous molecule or MERS-CoV-specific fragment thereof wherein said peptidase protein is a dipeptidyl peptidase 4 (DPP4), preferably human DPP4, or a fragment of DPP4.

Typically the invention provides a proteinaceous substance having been provided with an isolated or recombinant proteinaceous molecule or MERS-CoV-specific fragment thereof encoded by a nucleic acid according to the invention and additionally comprising at least a fragment of an N-terminal dipeptidyl peptidase protein, said substance having been subjected to crystallization. The invention also provides a container provided with a proteinaceous substance having been provided with a isolated or recombinant proteinaceous molecule according to the invention or fragment thereof encoded by a nucleic acid according to the invention and additionally having been provided with or comprising at least a fragment of an N-terminal dipeptidyl peptidase protein.

The invention also provides a method of identifying a candidate modulator as an agent that modulates the function of a dipeptidyl peptidase, said method comprising: providing a proteinaceous substance according to the invention in the presence and absence of said candidate modulator under conditions permitting binding of said proteinaceous molecule of first fragment of viral fragment with said fragment of said peptidase protein, measuring binding of said molecule to said fragment, wherein a decrease or increase in binding in the presence of said candidate modulator, relative to binding in the absence of said candidate modulator, identifies said candidate modulator as an agent that modulates the function of a dipeptidyl peptidase. It is preferred that said molecule and/or said fragment is detectably labeled, preferably with a moiety selected from the group consisting of a radioisotope, a fluorophore, a quencher of fluorescence, an enzyme, and an affinity tag.

The invention also provides use of at least a fragment of a viral protein as an agent that modulates the function of an N-terminal dipeptidyl peptidase, for example such use is provided herein in a method according to the invention. Similarly, the invention provides use of a fragment of an N-terminal dipeptidyl peptidase as an agent that modulates the function of a viral protein for example such use is provided herein in a method according to the invention. The invention also provides use of an inhibitor of N-terminal dipeptidyl peptidase, such as ADA, or a functional equivalent thereof, in a method for detecting inhibition of replication of a virus in a cell, preferably wherein said peptidase is DPP4, more preferably wherein said virus is a Coronavirus. The invention also provides use of an inhibitor of N-terminal dipeptidyl peptidase cell-surface expression, such as adenosine, or a functional equivalent thereof, in a method for detecting inhibition of replication of a virus in a cell, preferably wherein said peptidase is DPP4, more preferably wherein said virus is a Coronavirus.

The invention thus further provides a method of detecting, in a sample, the presence of an agent that modulates the function of a dipeptidyl peptidase, the method comprising providing a substance with a first and a second fragment according to the invention in the presence and absence of the sample under conditions permitting binding of the first fragment with the second fragment. Measuring binding of the first fragment to the second fragment, wherein a decrease or increase in binding in the presence of the sample, relative to binding in the absence of the sample, identifies the sample as comprising an agent that modulates the function of a dipeptidyl peptidase.

The invention further provides a method of identifying a candidate modulator as an agent that modulates the function of a dipeptidyl peptidase, the method comprising providing a substance with a first and a second fragment according to the invention in the presence and absence of the candidate modulator under conditions permitting determining enzymatic activity of a peptidase. Measuring enzymatic activity of a peptidase, wherein a decrease or increase in enzymatic activity in the presence of the candidate modulator, relative to binding in the absence of the candidate modulator, identifies the candidate modulator as an agent that modulates the function of a dipeptidyl peptidase.

The invention further provides a method of detecting, in a sample, the presence of an agent that modulates the function of a dipeptidyl peptidase, the method comprising providing a substance with a first and a second fragment according to the invention in the presence and absence of the sample under conditions permitting determining enzymatic activity of a peptidase. Measuring enzymatic activity of a peptidase, wherein a decrease or increase in enzymatic activity in the presence of the sample, relative to binding in the absence of the sample, identifies the sample as comprising an agent that modulates the function of a dipeptidyl peptidase.

In a preferred embodiment, the invention further provides a method of identifying a candidate modulator as an agent that modulates the function of a dipeptidyl peptidase or provides a method of detecting, in a sample, the presence of an agent that modulates the function of a dipeptidyl peptidase, wherein the first fragment and/or the second fragment is detectably labeled, preferably wherein the first fragment and/or the second fragment is detectably labeled with a moiety selected from the group consisting of a radioisotope, a fluorophore, a quencher of fluorescence, an enzyme, and an affinity tag. It is also provided that the substance comprises a cell expressing the first fragment and/or the second fragment. The invention also provides a method of identifying a candidate modulator as an agent that modulates the function of a dipeptidyl peptidase, said method comprising providing a proteinaceous substance according to the invention in the presence and absence of said candidate modulator under conditions permitting binding of a first fragment derived from a virus with a second fragment derived from a peptidase protein, and measuring binding of said first to said second fragment, wherein a decrease or increase in binding in the presence of said candidate modulator, relative to binding in the absence of said candidate modulator, identifies said candidate modulator as an agent that modulates the function of a dipeptidyl peptidase, it is preferred that said first and/or said second fragment is detectably labeled, preferably with a moiety selected from the group consisting of a radioisotope, a fluorophore, a quencher of fluorescence, an enzyme, and an affinity tag. The invention also provides a method of identifying a candidate antiviral agent as an agent that modulates the binding of a virus to dipeptidyl peptidase, said method comprising providing a proteinaceous substance according to the invention in the presence and absence of said candidate antiviral agent under conditions permitting binding of a first fragment derived from a virus with a second fragment derived from a peptidase protein, measuring binding of said first to said second fragment, wherein a decrease or increase in binding in the presence of said antiviral agent, relative to binding in the absence of said candidate modulator, identifies said antiviral agent as an agent that modulates the function of a dipeptidyl peptidase. It is preferred that said first and/or second fragment is detectably labeled, preferably with a moiety selected from the group consisting of a radioisotope, a fluorophore, a quencher of fluorescence, an enzyme, and an affinity tag.

The invention also provides use of a substance, a container or a method according to the invention for identifying an agent that modulates the function of a peptidase or a viral protein, use of an isolated fragment of a viral protein, preferably of a viral spike protein as provided herein, or recombinant or synthetic peptide derived thereof as provided herein, as an agent that modulates the function of an N terminal dipeptidyl peptidase, and use of an isolated fragment of a N terminal dipeptidyl peptidase, preferably of a soluble fragment of said peptidase as provided herein, or recombinant or synthetic peptide derived thereof as provided herein, as an agent that modulates the function of a viral protein. The invention further provides use of an inhibitor, preferably ADA, or a functional equivalent thereof, of N terminal dipeptidyl peptidase activity of a cell, for inhibition of replication of a virus in a cell, in particular, wherein the peptidase is DPP4, preferably human DPP4, preferably wherein the virus is a Coronavirus. The invention further provides use of an inhibitor, preferably adenosine, or a functional equivalent thereof, of N terminal dipeptidyl peptidase cell surface expression on a cell, for inhibition of replication of a virus in a cell, in particular, wherein the peptidase is DPP4, preferably human DPP4, preferably wherein the virus is a Coronavirus.

In describing protein or peptide composition, structure and function herein, reference is made to amino acids. In the present specification, amino acid residues are expressed by using the following abbreviations. Also, unless explicitly otherwise indicated, the amino acid sequences of peptides and proteins are identified from N terminal to C terminal, left terminal to right terminal, the N terminal being identified as a first residue. Ala: alanine residue; Asp: aspartate residue; Glu: glutamate residue; Phe: phenylalanine residue; Gly: glycine residue; His: histidine residue; Ile: isoleucine residue; Lys: lysine residue; Leu: leucine residue; Met: methionine residue; Asn: asparagine residue; Pro: proline residue; Gln: glutamine residue; Arg: arginine residue; Ser: serine residue; Thr: threonine residue; Val: valine residue; Trp: tryptophane residue; Tyr: tyrosine residue; Cys: cysteine residue. The amino acids may also be referred to by their conventional one letter code abbreviations; A=Ala; T=Thr; V=Val; C=Cys; L=Leu; Y=Tyr; I=Ile; N=Asn; P=Pro;

Q=Gln; F=Phe; D=Asp; W=Trp; E=Glu; M=Met; K=Lys; G=Gly; R=Arg; S=Ser; and H=His.

FIGURE LEGENDS

FIG. 1. Light microscopy images of LLC-MK2 cells (A, B) and VERO cells (C, D) inoculated with phosphate-buffered saline (A, C) or novel human coronavirus HCoV-SA1 (B, D) 5 days after inoculation.

Figure 2:
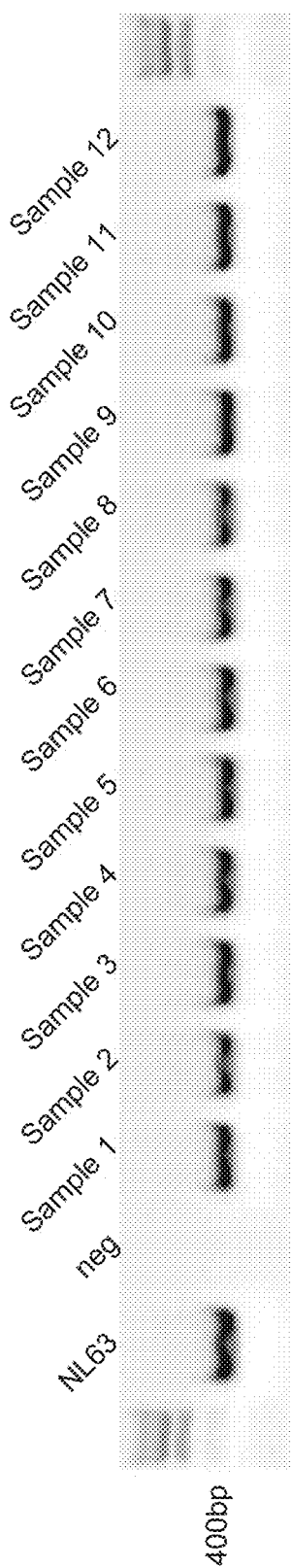

FIG. 2. Results of pan-coronavirus PCR. Various samples (numbered 1-12) of cell culture supernatants infected with HCoV-SA1 reacted with a pair of primers specific for the coronavirus family. A positive control virus (HCoV-NL63) was also reactive.

FIG. 3. Partial open reading frame of HCoV-SA1 (SEQ ID NO: 4).

Figure 4:
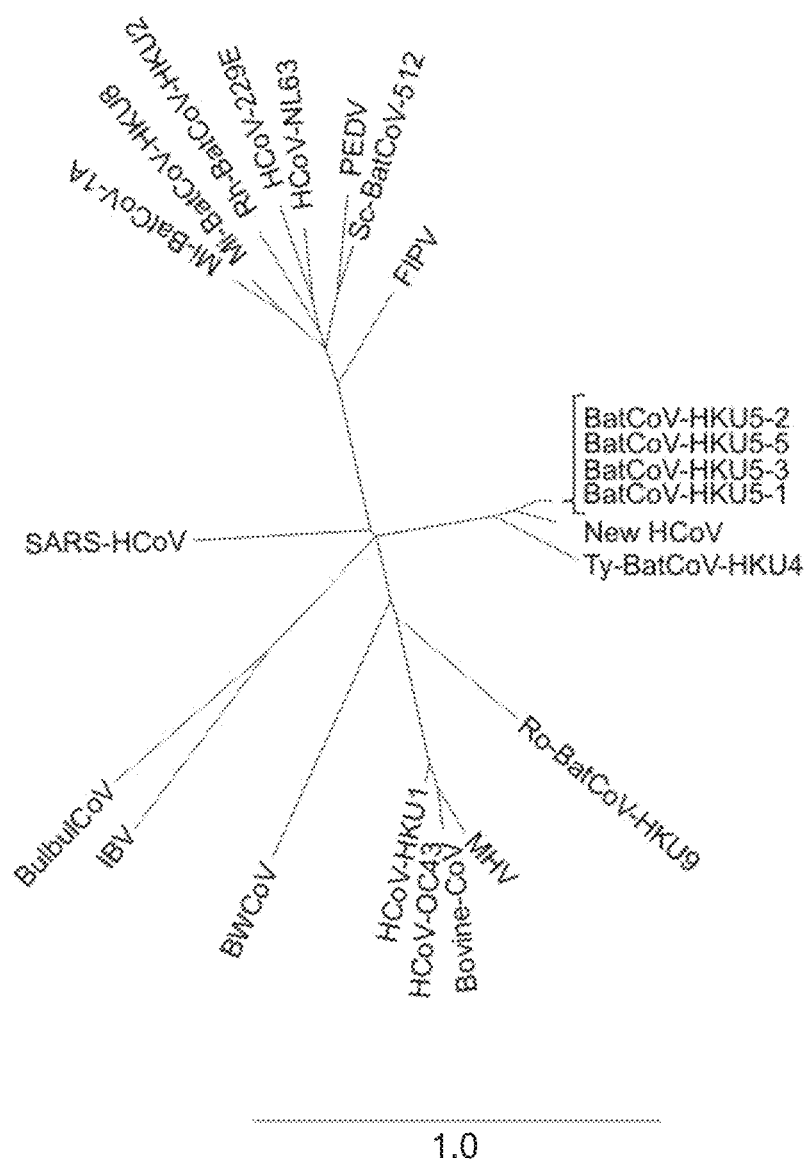

FIG. 4. Maximum Likelihood tree of partial polymerase gene sequences of representative coronaviruses. HCoC-SA1 is shown in the cluster on the right hand side of the tree, labeled as "New HCoV". The cluster of viruses at the top represents viruses in the genus *alphacoronavirus*. The Beluga whale coronavirus (BWCoV) represents a *gammacoronavirus*, while the Bulbul-CoV and IBV represent a proposed new genus of the coronavirinae.

FIG. 5 file N.rtf nucleocapsid (N) protein (SEQ ID NO: 5).

FIG. 6 file M.rtf matrix (M) protein (SEQ ID NO: 6).

FIG. 7 file E.rtf small envelope (E) protein (SEQ ID NO: 7).

FIG. 8 file NS3d.rtf non-structural gene NS3d (SEQ ID NO: 8).

FIG. 9 file NS3c.rtf non-structural gene NS3c (SEQ ID NO: 9).

FIG. 10 file NS3b.rtf non-structural gene NS3b (SEQ ID NO: 10).

FIG. 11 file NS3a.rtf non-structural gene NS3a (SEQ ID NO: 11).

FIG. 12 file S.rtf spike surface glycoprotein (S) (SEQ ID NO: 12).

FIG. 13 file Orf1ab.rtf encoding many enzymatic products among which the replicase (SEQ ID NO: 13).

FIG. 14 file HCoV-SA1.rtf (SEQ ID NO: 14).

FIG. 15 HCoV-SA1.rtf translation 3 frames (nucleic acid sequence is SEQ ID NOs: 15, 489, 653; amino acid sequences of reading frame 1 are SEQ ID NOs: 16-488, amino acid sequences of reading frame 2 are SEQ ID NOs: 490-652, and amino acid sequences of reading frame 3 are SEQ ID NOs: 654-1133).

FIG. 16 Amino acid sequence of the spike protein of HCoV EMC (HCoV SA1). Panel A, schematic presentation of the HCoV EMC S and S1 Fc fusion protein. Position of the predicted N glycosylation sites (ψ; predicted by the NetNGlyc server) and TM domain (yellow bar; predicted by the TMHMM server) are indicated in the full length S protein. The border between the S1 and S2 subunits is marked by the presence of a predicted furin cleavage site (red triangle; predicted by the ProP 1.0 server). Residues 1 747 comprise the N terminal region. Panel B, amino acid sequence of the spike protein with the S1 region indicated in red (SEQ ID NO: 1134).

FIG. 17 Amino acid sequence and domain structure of residues 1 747 of the S1 spike protein of HCoV EMC (HCoV SA1) (SEQ ID NO: 1135). RBD=Receptor Binding Region.

FIG. 18 Domain structure and amino acid sequence of residues 1 766 of human DPP IV (SEQ ID NO: 1136), domain borders based on crystal structure (Rasmussen, Nat. Struct. Biol. 2003, herein included by reference).

Figure 19:
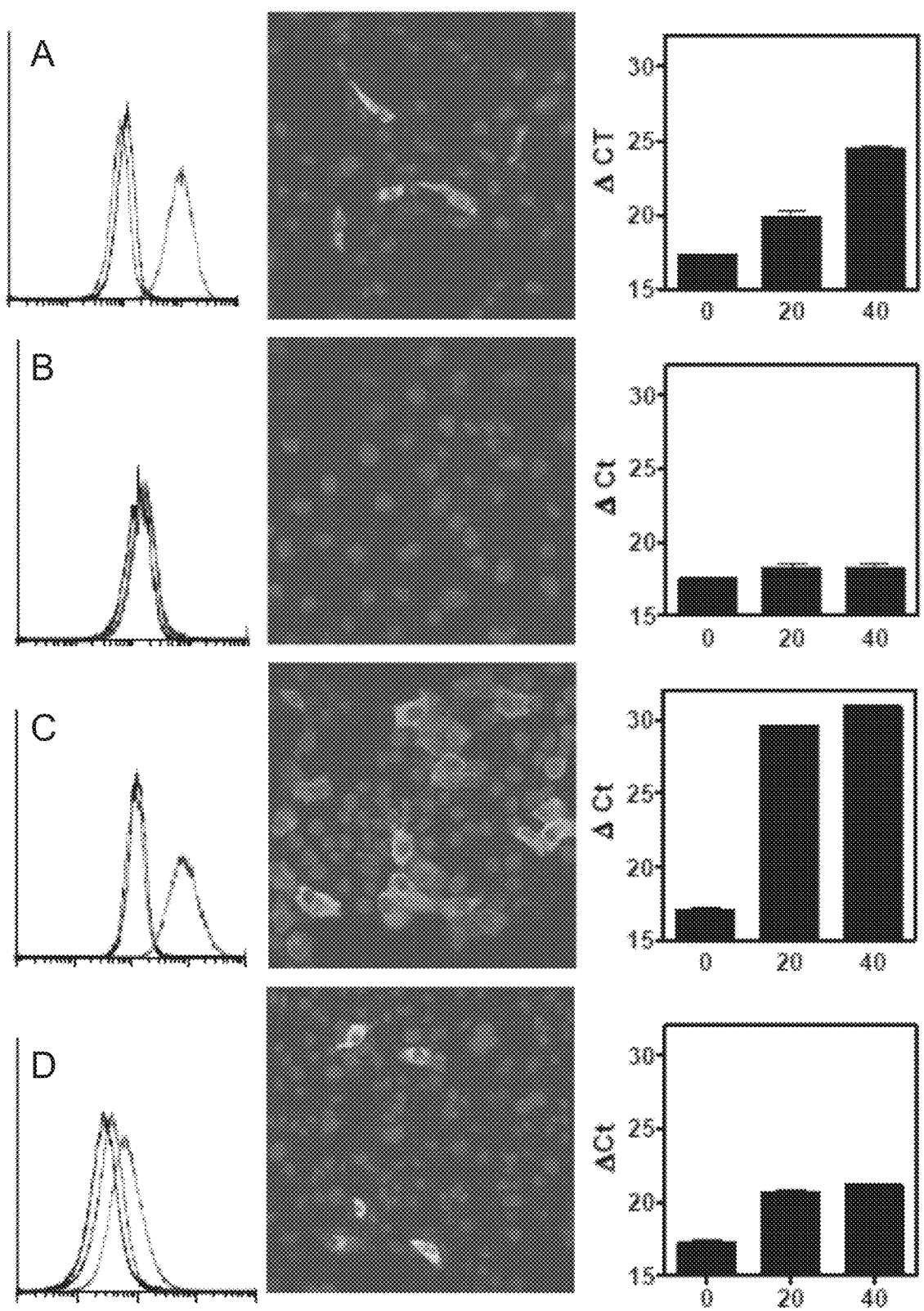

FIG. 19 Binding of HCoV EMC S1 is correlated to infection with HCoV EMC in vero cells (Panel A), Cos 7 cells (Panel B) Huh7 cells (Panel C) and bat cells (Panel D). Shown on the left is the FACS analysis of HCoV EMC S1 binding (red line), a feline CoV S1 protein as control (blue line) and non stained cells (black line). In the middle panels, HCoV EMC infected cells are visualized using an antiserum that recognizes the NSp4 protein and on the left, supernatants of the infected cells are tested by Taqman for the presence of viral transcripts at 0, 20 and 40 hours after infection.

Figure 20:
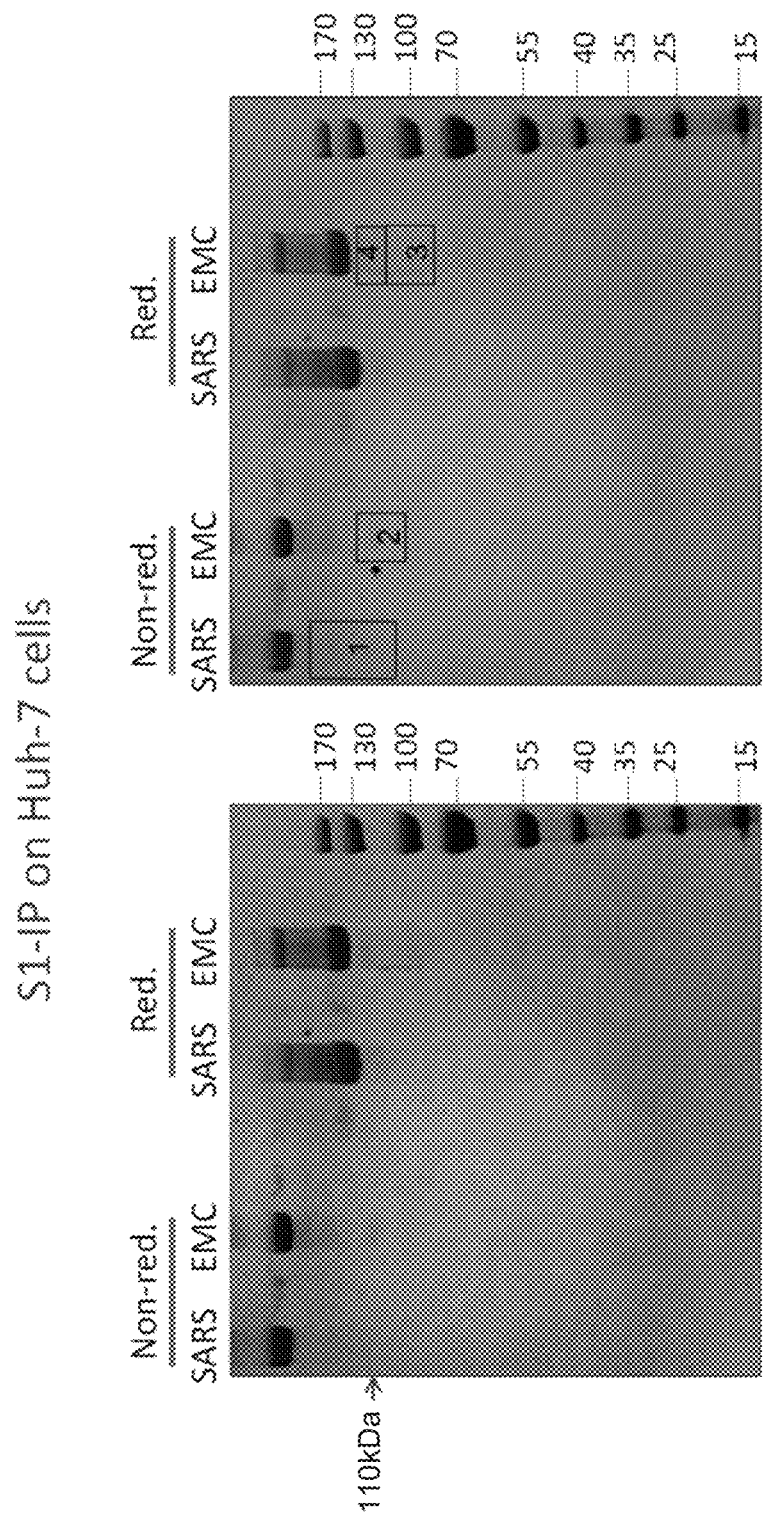

FIG. 20 Immunoprecipitation with S1 on Huh7 cells and mass spec analysis reveals cd26 as the interacting protein.

FIG. 21 Peptides identified in fraction 2 are indicated in red and relate to the fragment or topological domain involving residues 29 766 comprising the extracellular region (ectodomain) of the membrane bound DPP4 (SEQ ID NO: 1137; Uniprot identifier P27487) but do not relate to the cytoplasmic domain (residues 1 6) nor to the helical Signal anchor for type II membrane protein domain (residues 7 28) of membrane bound DPP4. Soluble DPP4 runs from residue 39 to residue 766.

Figure 22:
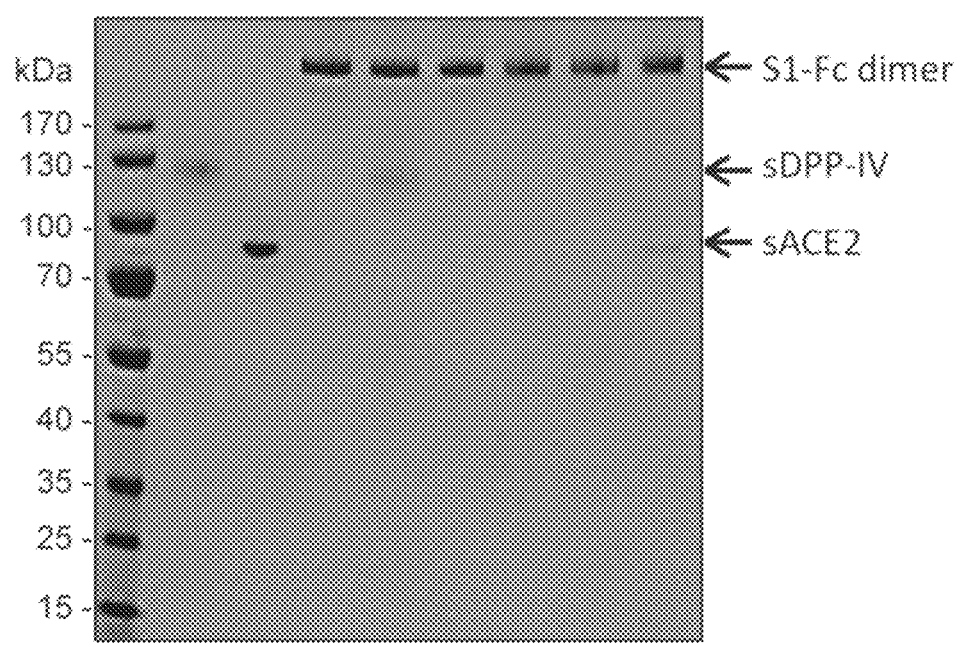

FIG. 22 HCoV EMC and SARS CoV S1 Fc proteins (2.5 μg) were mock incubated or incubated with 12.5 μg soluble DPP IV (sDPP IV) or soluble ACE2 (sACE2) in 100 μl PBS. Precipitates were washed thrice with lysis buffer and once with PBS, and subjected to a NOVEX® 4 12% Tris Glycine gradient gel (Invitrogen) under non reducing conditions.

Figure 23:
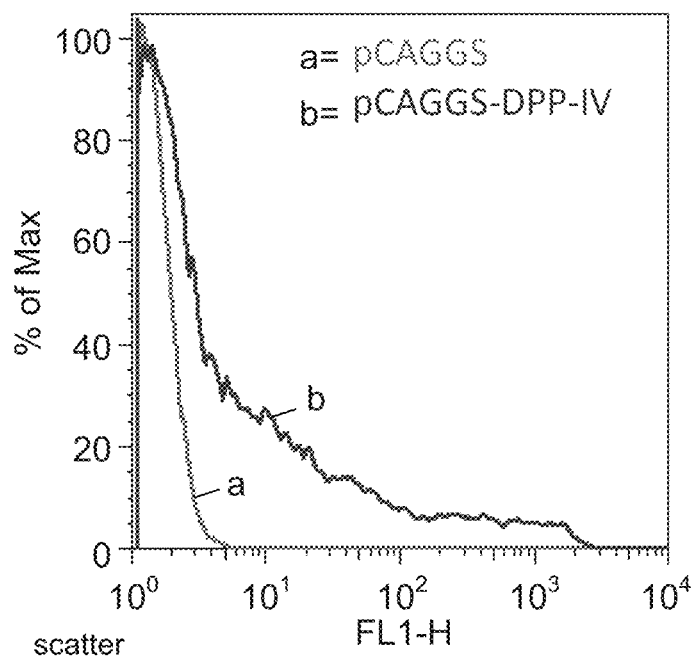

FIG. 23 Cells were washed twice with ice cold PBS, scraped off the plastic with a rubber policeman and suspended into single cells by pipetting cells up and down. S1 binding of cells was measured by incubating $2.5 \times 10^5$ cells with 15 μg/ml of S1 Fc followed by incubation with the fluorescent dye Alexa488 labeled goat anti human IgG antibody and analyzed by flow cytometry.

Figure 24:
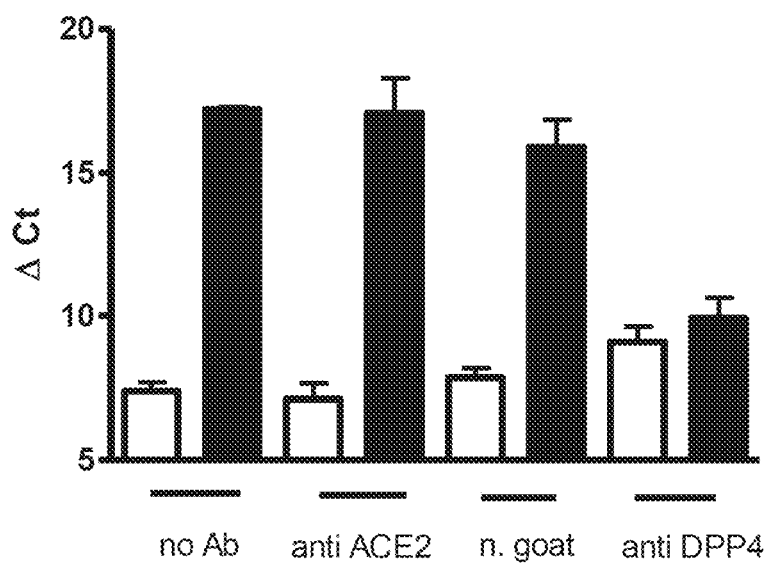

FIG. 24 Inhibition of HCoV EMC replication in Huh7 cells by antibodies to DPP4. Huh7 cells were incubated with 20 μg/ml goat polyclonal antiserum against DPP4, a goat antiserum against ACE2, normal goat serum or left untreated. After 1 hour incubation, the cells were infected with HCoV EMC at a multiplicity of infection of 0.01 and left for 1 hour. Cells were washed twice and again incubated with medium containing the respective antibodies. Supernatant collected at 2 hours (open bars) and 20 hours (closed bars) was tested for presence of HCoV using a Taqman assay. Results are shown as Δ Ct. HCoV EMC infection of Huh7 cells is inhibited by antibodies to DPP4 but not by the other antibodies tested.

Figure 25:
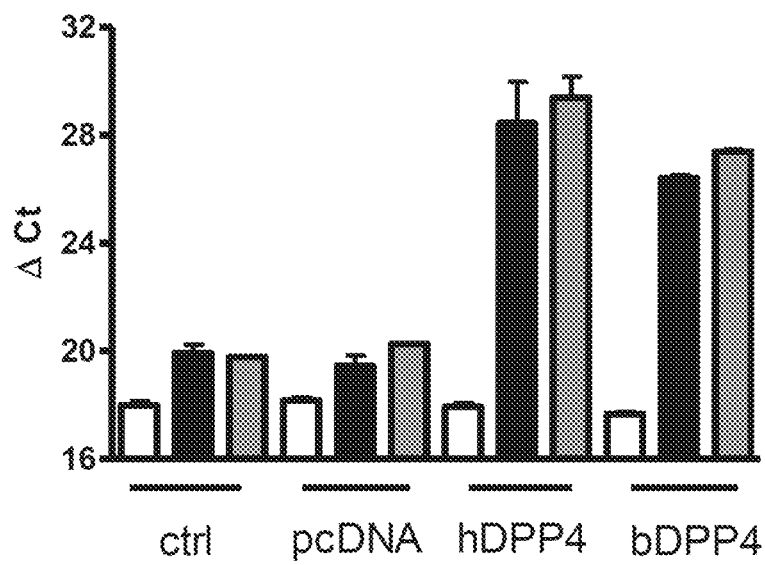

FIG. 25 Cos7 cells transfected with plasmids encoding human DPP4 (hDPP4) or bat DPP4 (bDPP4), a control plasmid (pcDNA) or left untreated were infected with HCoV EMC at a multiplicity of infection of 1 and left for 1 hour. Cells were washed twice and supernatant collected at 2 hours (open bars), 20 hours (blue bars) and 40 hours (red bars) was tested for presence of HCoV using a Taqman assay. Results are shown as A Ct.

Figure 26:
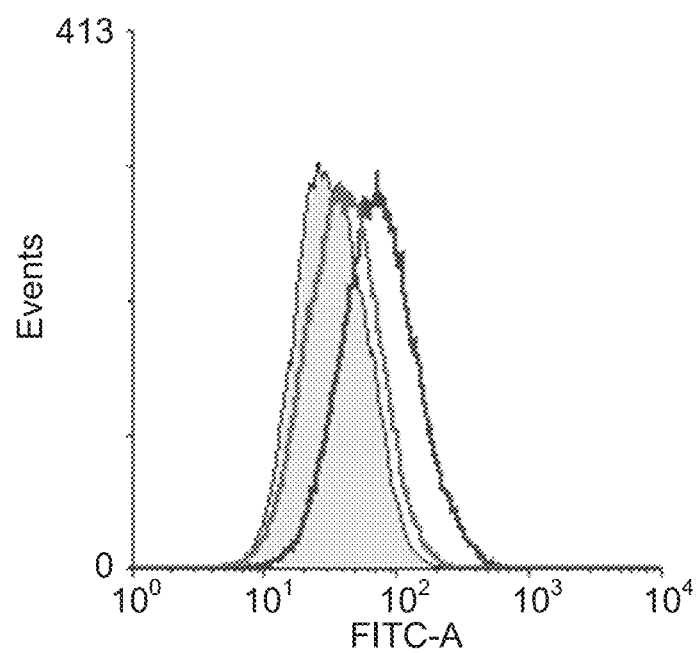

FIG. 26 Blocking of DPP4-S1 binding by antibodies directed against S1 serum from a macaque infected with HCoV EMC inhibits binding of recombinant S1 to Huh7 cells. Serum at a dilution of 1:20, obtained from macaques at day 0 (blue line) and day 14 (red line) after infection with $5 \times 10^7$ TCID50 HCoV EMC, was preincubated for 1 hour at room temperature with 1.25 μg/ml recombinant S1 protein that was biotinylated and subsequently incubated on Huh7 cells. After treatment with FITC-labeled streptavidin, cells were analyzed for fluorescence. In gray background, binding using a control biotinylated protein is shown.

Figure 27:
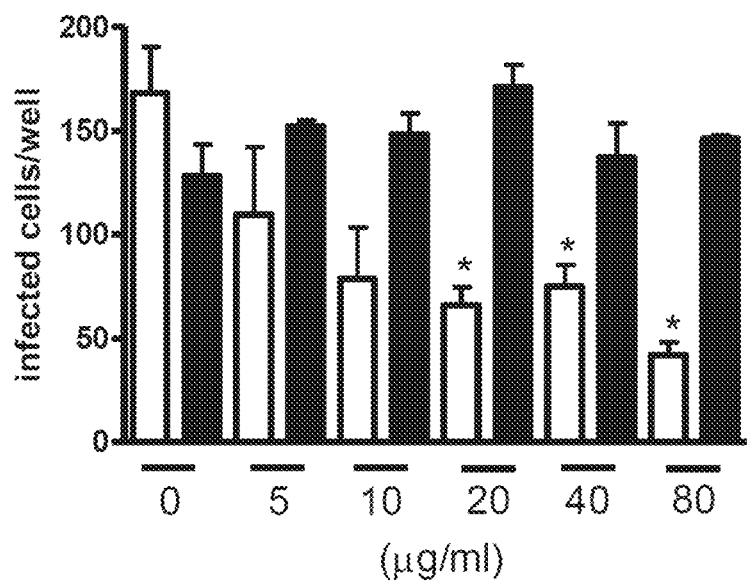

FIG. 27 Inhibition of HCoV EMC replication in Huh7 cells by soluble adenosine deaminase (ADA). Huh7 cells were incubated with different concentrations of recombinant soluble ADA (closed bars) or recombinant soluble ACE2 (open bars). After 1 hour incubation, the cells were infected with HCoV EMC at a multiplicity of infection of 0.01. After 8 hours, cells were fixed and stained with a rabbit antiserum against HCoV EMC nsp4 and cells were counted. Results are shown as number of infected cells per well. Infection of Huh7 cells is inhibited by recombinant soluble ADA but not by recombinant soluble ACE2.

Figure 28:
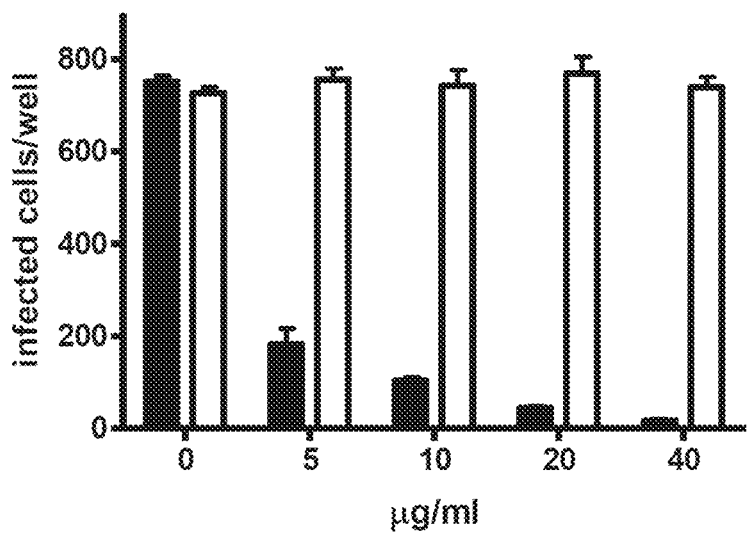

FIG. 28 Inhibition of HCoV EMC replication in Huh7 cells by soluble DPP4. Different concentrations of recombinant soluble DPP4 (open bars) or recombinant soluble ACE2 (closed bars) were incubated with HCoV EMC for 1 hour at 37° C. and used to infect Huh7 cells. After 8 hours, cells were fixed and stained with a rabbit antiserum against HCoV EMC nsp4 and cells were counted. Results are shown as number of infected cells per well. Infection of Huh7 cells is inhibited by recombinant soluble DPP4 but not by recombinant soluble ACE2.

Figure 29A:
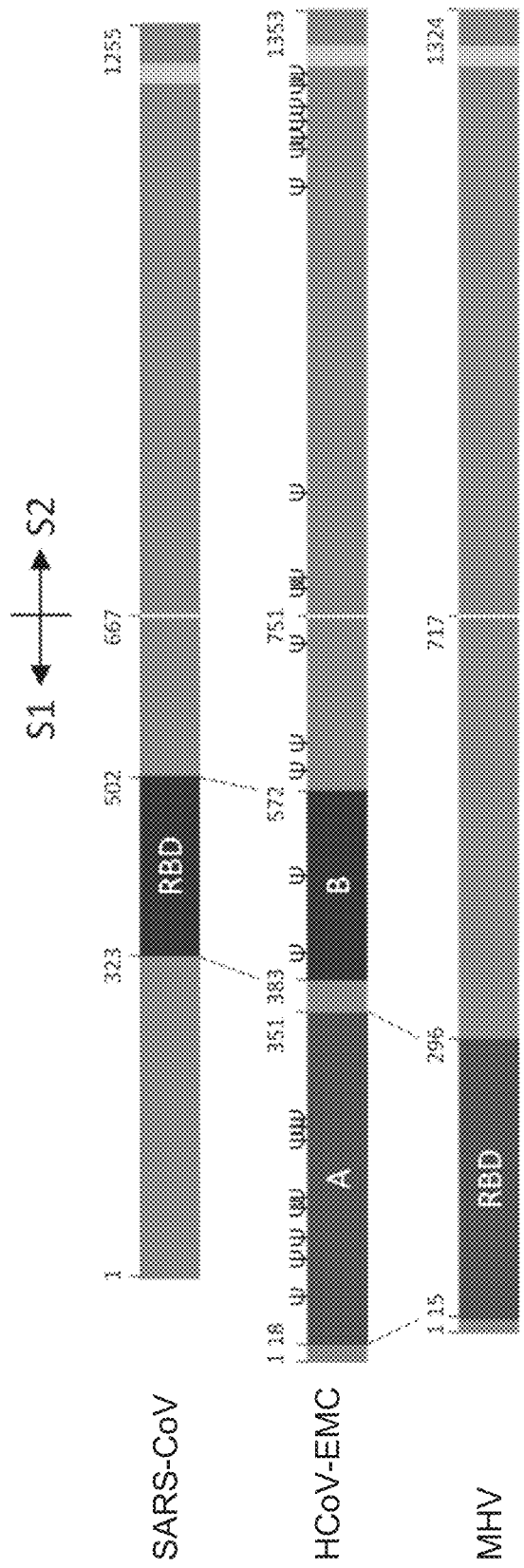
Figure 29B:
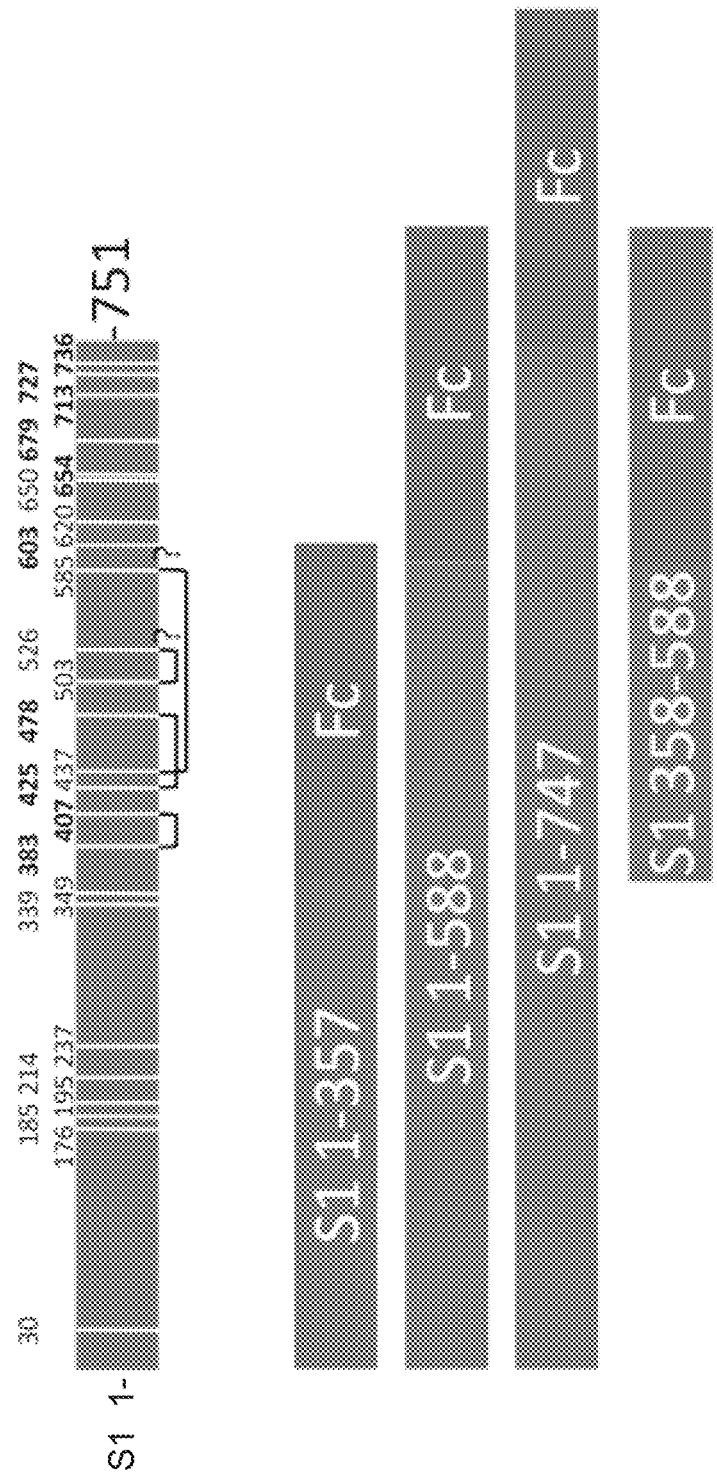

FIG. 29 Receptor binding domains in *betacoronavirus* spike proteins and S1 Fc expression constructs. Panel a), schematic representation of the *betacoronaviruses* SARS CoV, hCoV EMC S and MHV (strain A59) spike (S) protein sequence (drawn to scale) aligned at the S1 S2 junction. The known receptor binding domain in the S1 subunit of MHV and SARS CoV S proteins and their corresponding homologous regions in hCoV EMC S as defined by ClustalW alignment are indicated. Positions of the transmembrane domain (yellow bar; predicted by the TMHMM server) and of the predicted N glycosylation sites (W; predicted by the NetNGlyc server, only shown for the hCoV EMC S) are indicated. The border between the S1 and S2 subunits of the spike protein is represented by a vertical white line. Panel b), upper panel, schematic presentation of the hCoV EMC S1 subunit (residues 1 751) sequence. Cysteine positions in S1 subunit are indicated by vertical white lines with corresponding amino acid positions on top. Positions of cysteines highly conserved among *betacoronaviruses* S1 proteins are in bold. Predicted disulfide bond connections inferred from the structure of the SARS CoV receptor binding domain are presented as connecting black lines underneath. Lower panel, domains of the hCoV EMC S1 subunit expressed as Fc chimeras.

Figure 30A:
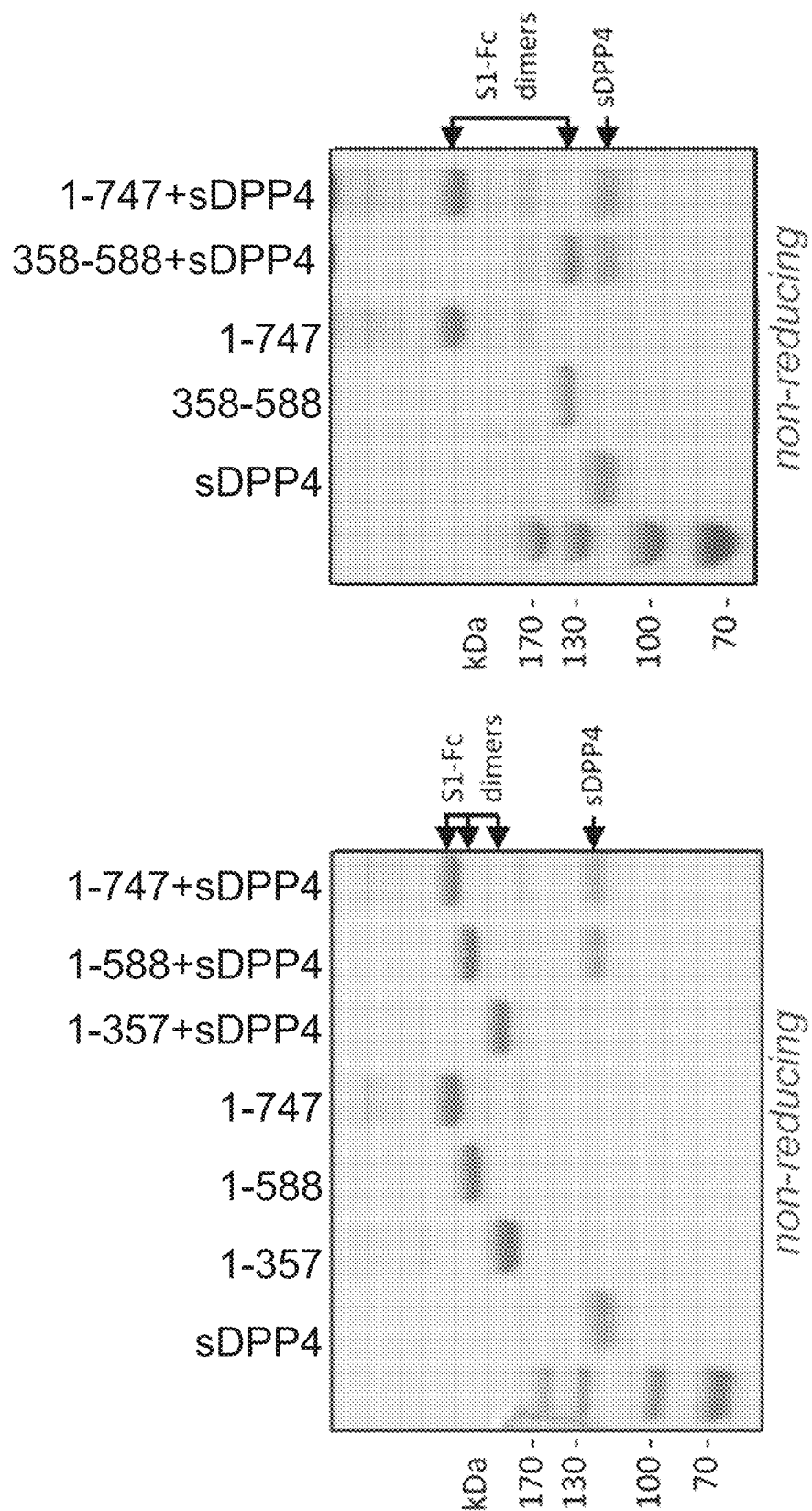
Figure 30C:
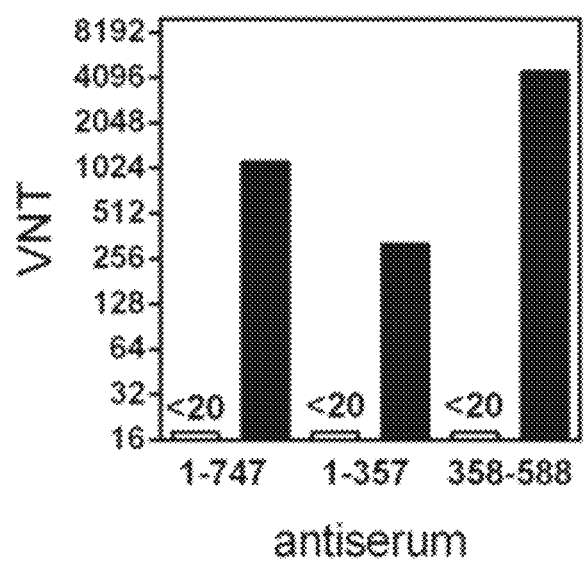

FIG. 30 The DPP4 binding domain is located within residues 358 588 of the hCoV EMC spike protein and efficiently elicits neutralizing antibodies. Panel a), S1 Fc chimeric proteins and soluble DPP4 (sDPP4) receptor were expressed from HEK 293T cells and purified from the culture supernatant. S1 Fc proteins were mixed with sDPP4 followed by protein A sepharose affinity isolation, analyzed on a NOVEX® 4 12% Tris Glycine gradient gel under non reducing conditions, and stained with GelCodeBlue reagent. Position of the S1 Fc proteins, running as dimers under non reducing conditions due to an Fc interchain disulphide bond, and sDPP4 as well as the sizes of the marker proteins are indicated. Individual proteins were loaded as controls. Panel b), binding of hCoV EMC S1 Fc proteins to DPP4 expressing cells. 2.5×105 HEK 293T cells transfected with control pCAGGS (grey shaded area) or with pCAGGS DPP4 (black line) expression plasmid were incubated with 15 µg/ml of the indicated S1 Fc followed by incubation with DyLight488 labeled goat anti human IgG antibody and analysis by flow cytometry. An Fc chimera containing the S1 of infectious bronchitis virus (IBV S1 Fc) was taken along as a negative control. Panel c), neutralization of hCoV EMC infection by rabbit antisera raised against the S1 Fc 1 747, 1 357 and 358 588 variants. Virus (100 pfu) was premixed 1:1 with serial dilutions of sera obtained (open bars) or after immunization (closed bars) prior to inoculation onto VERO cells and virus infection was monitored by the occurrence of CPE at 72 hours post infection. Virus neutralization titers (VNT) were determined in quadruplicate as the highest serum dilutions that completely prevent CPE. The experiment was carried out twice and the data of one representative experiment are shown.

Figure 31:
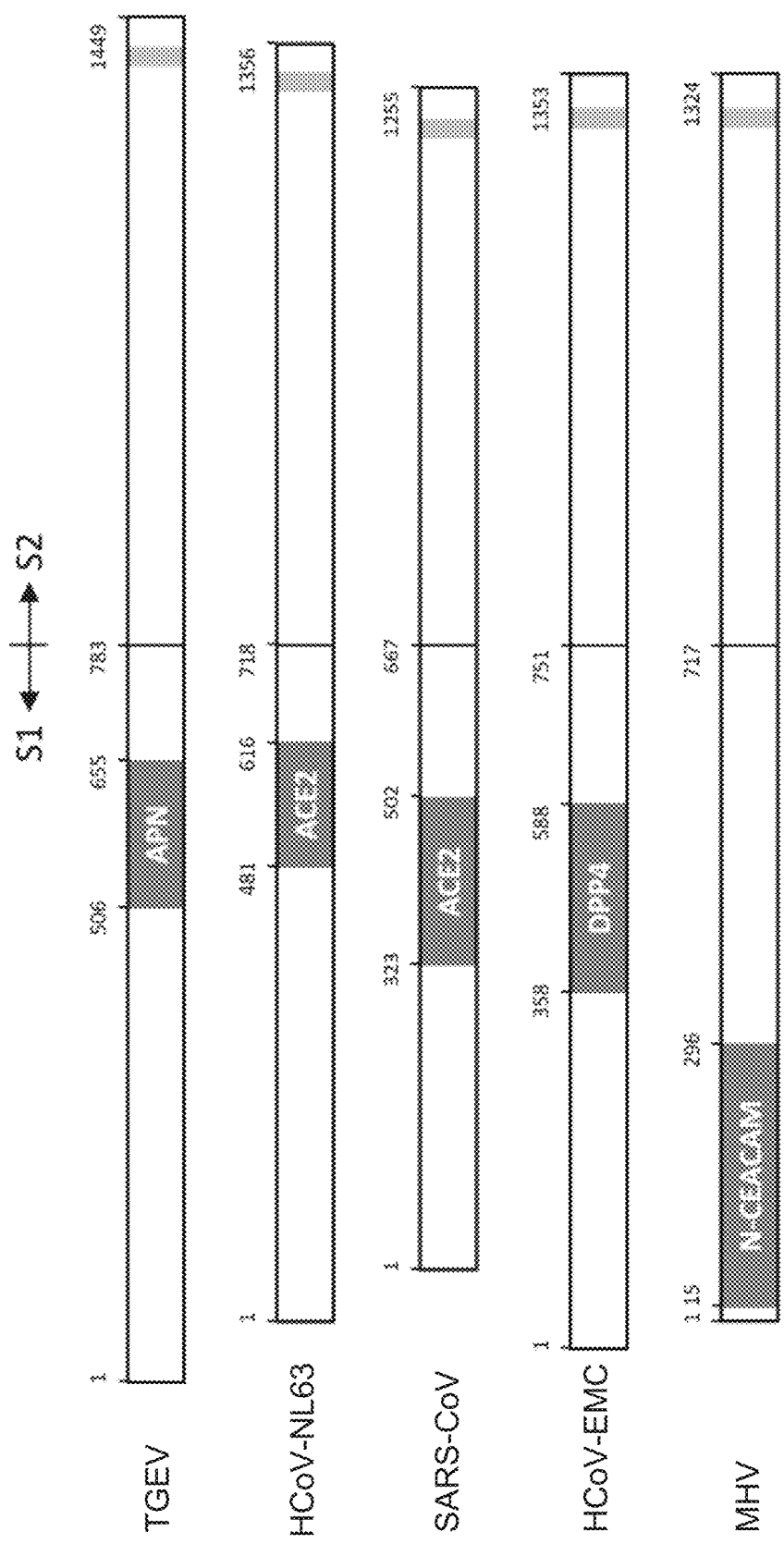

FIG. 31 Localization of receptor binding domains in coronavirus spike proteins. Schematic presentation of the spike proteins of the *alphacoronaviruses* TGEV and hCoV NL63 and of the *betacoronaviruses* SARS CoV, hCoV EMC and MHV (drawn to scale), aligned at the S1 S2 junction. Blue boxes represent the receptor binding domains (RBD) and indicate the engaged receptor. The RBD of TGEV, hCoV NL63, SARS CoV and MHV have been confirmed by crystallography (12, 15, 22, 26). Grey boxes indicate the transmembrane domain. Sequence IDs: TGEV (ABG89335.1), hCoV NL63 (NC_005831.2), SARS CoV (NP_828851.1), hCoV EMC (AFS88936.1), MHV (NC_001846.1).

FIG. 32 Residues 363 593 of the spike protein of HKU4 CoV bind to human DPP4. Shown is the binding ability of different 51 Fc proteins to DPP4 expressing cells. 2.5×105 HEK 293T cells transfected with control pCAGGS (grey shaded area) or with pCAGGS DPP4 (black line) expression plasmid were incubated with 15 pg/ml of the hCoV EMC 51 Fc followed by incubation with DyLight488 labeled goat anti human IgG antibody and analysis by flow cytometry. EMC S (SEQ ID NO: 1138); HKU5 S (SEQ ID NO: 1139); and HKU4 S (SEQ ID NO: 1140). 51 Fc protein chimeras were tested containing the hCoV EMC S1 subunit (residues 1 747), the hCoV EMC spike receptor binding domain (RBD; residues 358 588; SEQ ID NO: 1141) or the hCoV EMC RBD homologous regions of the spike proteins of HKU4 CoV (residues 363 593; SEQ ID NO: 1142) and HKU5 CoV (residues 366 586; SEQ ID NO: 1143). Mock incubated cells (mock) or cells incubated with an Fc chimera containing the S1 of feline infectious peritonitis virus (FIPV S1 Fc) was taken along as negative controls.

HKU4 CoV spike (S) protein ID [YP_001039953.1].
HKU5 CoV spike (S) protein ID [YP_001039962.1].
Region in S homologous to hCoV EMC RBD highlighted in yellow.

FIG. 33. Characterization of the functional MERS-CoV DPP4 receptor S1 binding site.

A, Different plasmids encoding either full length human DPP4, ferret DPP4 or human-ferret DPP4 chimera's (human-ferret-human and ferret-human ferret, HFH and FHF respectively) were constructed. B, DPP4 expression and S1 binding to cells transfected with different DPP4 constructs as analysed by FACS analysis. C, MERS-CoV RNA levels in supernatants of DPP4 transfected cells infected with MERS-CoV at 2 and 20 h after infection
using a TaqMan assay, expressed as genome equivalents (GE; half maximal tissue-culture infectious dose (TCID50) per ml). D, S1 binding to cells transfected with different hDPP4 mutants. E, MERS-CoV infection of cells transfected with different hDPP4 constructs. Data in panel a and b were corrected for DPP4 expression of the different constructs.

DETAILED DESCRIPTION

Novel Human Coronavirus HCoV-SA1

Classification:
Order: Nidovirales
Family: Coronaviridae
Subfamily: Coronavirinae
Genus: *Betacoronavirus*
Lineage: C

Example 1

Virus was isolated from a 60-year old man with acute pneumonia and acute renal failure in Saudi Arabia.

Virus was isolated from sputum specimen in VERO cells and LLC-MK2 cells.

Five days after inoculation, cytopathic effects were observed, consisting of rounding of the cells, detachment of cells, and syncytium formation (FIG. 1).

Cells in the original sputum sample and infected cultured cells were also tested with specific antibodies against influenza A and B viruses, parainfluenza viruses types 1-3, respiratory syncytial virus, and adenovirus, but such tests yielded negative results. Sputum specimens and infected cell culture supernatants did not react in PCR-based assays specific for paramyxoviruses, enteroviruses, and adenoviruses. However, these samples did react with PCR-based assays to detect all coronaviruses. A 251 nucleotide fragment was amplified with one such test (Vijgen, L., E. Moes, E. Keyaerts, S. Li, and M. Van Ranst. 2008. A pancoronavirus RT-PCR assay for detection of all known coronaviruses. Methods Mol Biol 454:3-12). A second PCR-based assay to detect all coronaviruses (Drosten C, Gunther S, Preiser W, van der Werf S, Brodt H R, Becker S, Rabenau H, Panning M, Kolesnikova L, Fouchier R A, Berger A, Burguière A M, Cinatl J, Eickmann M, Escriou N, Grywna K, Kramme S, Manuguerra J C, Müller S, Rickerts V, Sturmer M, Vieth S, Klenk H D, Osterhaus A D, Schmitz H, Doerr H W. Identification of a novel coronavirus in patients with severe acute respiratory syndrome. N Engl J Med. 348, 1967-76 (2003)) also yielded positive results (FIG. 2).

Example 2

Viral RNA was isolated from infected cell culture supernatants using a High Pure RNA Isolation Kit (Roche). Extracted RNA was copied to cDNA by reverse transcriptase using random hexamers. Pan-coronavirus polymerase chain reaction (PCR) was used to amplify a conserved region of open reading frame 1b (Drosten C, Gunther S, Preiser W, van der Werf S, Brodt H R, Becker S, Rabenau H, Panning M, Kolesnikova L, Fouchier R A, Berger A, Burguiere A M, Cinatl J, Eickmann M, Escriou N, Grywna K, Kramme S, Manuguerra J C, Müller S, Rickerts V, Sturmer M, Vieth S, Klenk H D, Osterhaus A D, Schmitz H, Doerr H W. Identification of a novel coronavirus in patients with severe acute respiratory syndrome. N Engl J Med. 348, 1967-76 (2003)). The PCR fragments of the pan-coronavirus PCRs were sequenced. To this end, PCR products were purified from the gel and sequenced using a BigDye Terminator v3.1 Cycle sequencing kit (Applied Biosystems, Nieuwerkerk a/d IJssel, the Netherlands) and a 3130XL genetic analyzer (Applied Biosystems), according to the instructions of the manufacturer. The sequence clearly corresponded with conserved region of open reading frame 1b of a coronavirus (FIG. 3).

Example 3

Reference coronavirus genome sequences were downloaded from GenBank and the part of the genomes that corresponded with the amplified fragment of HCoV-SA1 were aligned. A Maximum Likelihood tree was constructed to infer the phylogenetic relationships (FIG. 4). This phylogenetic tree showed that the new HCoV-SA1 belongs to lineage C of the genus *Betacoronavirus*, along with the bat coronaviruses HKU4 and HKU5. The *Betacoronavirus* genus contains 3 additional lineages (A, B, D). HCoV-HKU1 and HCoV-OC43 belong to lineage A while SARS-CoV belongs to lineage B. Lineage D does not contain any human pathogens, and is represented in the tree by Rousettus bat coronavirus HKU9.

HCoV-SA1 is thus clearly distinct from previously known human coronaviruses. HCoV-NL63 and HCoV-229E are even more distinct from HCoV-SA1, since these two human pathogens belong to a different genus, the *Alphacoronavirus* genus.

Example 4

To further characterize the virus genome, viral RNA was extracted from infected cell culture supernatant using the High Pure RNA Isolation Kit (Roche). RNA was subjected to reverse transcriptase using circular permuted primers (Welsh, J. & McClelland, M. Fingerprinting genomes using PCR with arbitrary primers. Nucleic Acids Res. 18, 7213-7218 (1990)) that were extended with random hexamer sequences. The amount of DNA was amplified by polymerase chain reaction (PCR), using the circular permuted primers. The randomly amplified fragments were sequenced using the 454/Roche GS-FLX sequencing platform. A fragment library was created according to the manufacturer's protocol without DNA fragmentation (GS FLX Titanium Rapid Library Preparation, Roche). The emPCR (Amplification Method Lib-L) and GS junior sequencing run was performed according to instructions of the manufacturer (Roche). The sequence reads were trimmed at 30 nucleotides from the 3' and 5' ends to remove all primer sequences. Sequence reads from the GS-FLX sequencing data were assembled into contigs using CLC Genomics software 4.6.1. Using this "deep-sequencing" approach on the 454-sequencing platform, approximately 80% of the virus genome sequence was obtained. Subsequently, specific primers were designed to amplify 30 overlapping fragments of approximately 1500 basepairs by PCR. Each of these PCR products was sequenced using conventional Sanger sequencing. To this end, PCR products were purified from the gel and sequenced using a BigDye Terminator v3.1 Cycle sequencing kit (Applied Biosystems, Nieuwerkerk a/d IJssel, the Netherlands) and a 3130XL genetic analyzer (Applied Biosystems), according to the instructions of the manufacturer. The nearly full-length sequence is presented in file HCoV-SA1.rtf. This sequence contains some uncertainties within the extreme 50 nucleotides of both ends. However, this information is not required to classify the coronavirus. The same figure also displays the full coding potential of HCoV-SA1. As a minimum, the HCoV-SA1 virus genome encodes the open reading frames common to the virus of the *betacoronavirus* genus, including orf1ab that encodes many enzymatic products, the spike surface glycoprotein (S), the non-structural genes NS3a, NS3b, NS3c, NS3d, the small envelope (E) protein, the matrix (M) protein, and the nucleocapsid (N) protein. Open reading frames are presented in files Orf1ab.rtf, S.rtf, NS3a.rtf, NS3b.rtf, NS3c.rtf, NS3d.rtf, E.rtf, M.rtf, N.rtf. Other open reading frames may be present.

Example 5

Comparison of the Orf1ab gene product of HCoV-SA1 with those of the other members of the *Betacoronavirus* genus, HKU4 and HKU5 was used to test if HCoV-SA1 belongs to one of these known species or represents a new species within the genus. The International Committee on the Taxonomy of Viruses (ICTV) considers viruses that share more than 90% aa sequence identity in the conserved replicase domains to belong to the same species. This 90% identity threshold serves as the sole species demarcation criterion. Since amino acid sequence identity of Orf1ab between HCoV-SA1 and HKU4 and HKU5 is below 74% (Table 1), we conclude that HCoV-SA1 represents a novel species of the *Betacoronavirus* genus, although such classification requires ICTV approval.

TABLE 1

Percentage amino acid sequence identity between ORF1ab of HCoV-SA1, HKU4 (Genbank accession numbers EF065505-EF065508) and HKU5 (accession numbers EF065509-EF065512)

|  | HCoV-SA1 | HKU4 | HKU5 |
|---|---|---|---|
| HCoV-SA1 | 100% | 72% | 74% |
| HKU4 | 72% | 99-100% | 77% |
| HKU5 | 74% | 77% | 99-100% |

The present invention in particular also relates to the spike (S) protein of a coronavirus and fragments thereof as depicted in FIGS. 16 and 17.

The present invention also relates to a member of the S9 family of human proteases known as dipeptidyl peptidase IV (DPPIV, FIG. 18), and fragments thereof.

Protein Expression

Example 6

A plasmid encoding HCoV EMC S1 Fc was generated by ligating a fragment encoding the S1 region (residues 1 747) into the pCAGGS expression vector as an N terminal fusion with the fragment encoding the Fc domain of human IgG (FIGS. 1 and 2). Likewise, an S1 Fc expression plasmid was made for the SARS coronavirus S1 subunit (strain Urbani: residues 1 676) and the FIPV S1 subunit (strain 79 1146; residues 1 788). S1 Fc proteins were expressed by transfection of the expression plasmids into 293T cells and affinity purified from the culture supernatant using protein A sepharose beads.

Example 7

A plasmid encoding the ectodomain of human DPP4 (FIG. 18) was generated by ligating a fragment encoding residues 39 766 of human DPP4 into a pCD5 expression vector encoding the signal sequence of CD5 and a OneSTrEP affinity tag (IBA GmbH). Soluble DPP4 ectodomain was expressed by transfection of the expression plasmid into 293T cells and affinity purified from the culture supernatant using Streptactin sepharose beads (IBA GmbH).

Example 8

A plasmid encoding HCoV EMC S1 Fc was generated by ligating a fragment encoding the S1 region (residues 1 747) into the pCAGGS expression vector as an N terminal fusion with the fragment encoding the Fc domain of human IgG separated by a thrombin cleavage site. Likewise, an Fc expression plasmid was made for the SARS coronavirus S1 subunit (isolate CUHK W1: residues 1 676), the FIPV S1 subunit (isolate 79 1146; residues 1 788) and the ectodomain of human ACE2 (sACE2; residues 1 614). Fc chimeric proteins were expressed by transfection of the expression plasmids into 293T cells and affinity purified from the culture supernatant using protein A sepharose beads (GE Healthcare). Purified ACE2 Fc was cleaved with thrombin and soluble ACE2 was purified by gel filtration.

Example 9

A plasmid encoding the ectodomain of human DPP IV (sDPP IV) was generated by ligating a fragment encoding residues 39 766 of human DPP IV into a pCD5 expression vector encoding the signal sequence of CD5 and the OneSTrEP tag (IBA GmbH). Soluble DPP IV ectodomain was expressed by transfection of the expression plasmid into HEK 293T cells and affinity purified from the culture supernatant using Strep Tactin Sepharose beads (IBA GmbH).

Pull Down; Immunoprecipitation and Detection of DPP4

Example 10

The immunoprecipitation protocol was essentially carried out as described before with some modifications (Li et al., 2003, Nature 426:450, included herein by reference). In short, Huh 7 cells were washed twice with ice cold PBS, scraped off the plastic with a rubber policeman, pelleted and lysed in ice cold lysis buffer (0.3% DDM in PBS) containing protease inhibitors (Roche Complete Mini) at a final density of ~2.5×107 cells/mL. Cell lysates were precleared with protein A sepharose beads after which 10 micrograms of probe S1 Fc was added to 1 ml of cell lysate and incubated for 1 hour at 4° C. under rotation. Precipitates were washed thrice with lysis buffer and once with PBS and subjected to NOVEX® 4 12% Tris Glycine gradient gel (Invitrogen) under reducing and non reducing conditions. A distinct 110 kDa band precipitated with EMC S1 Fc was visualized by GelCodeBlue staining, excised from the gel, incubated with trypsin and analyzed by MS. Results are shown in FIG. 20 and results of target analyses are shown in FIG. 21.

Example 11

DPP4 cell surface expression was measured using S1 Fc proteins. Cells were washed twice with ice cold PBS, scraped off the plastic with a rubber policeman and suspended into single cells by pipetting cells up and down. S1 binding of cells was measured by incubating 2.5×105 cells with 15 µg/ml of S1 Fc followed by incubation with the fluorescent dye Alexa488 labeled goat anti human IgG antibody and analyzed by flow cytometry. Results are shown in FIG. 23.

RNA Extraction and Quantitative RT PCR

Example 12

RNA from 200 µl of supernatant was isolated with the Magnapure LC total nucleic acid isolation kit (Roche)

external lysis protocol and eluted in 100 al. HCoV EMC RNA was quantified on the ABI prism 7700, with use of the Taqman Reverse Transcription Reagents and Taqman PCR Core Reagent kit (Applied Biosystems), using 20 μl isolated RNA, 1x Taqman buffer, 5.5 mM MgCl2, 1.2 mM dNTPs, 0.25 U Amplitaq gold DNA polymerase, 0.25 U Multiscribe reverse transcriptase, 0.4 U RNAse inhibitor, 200 nM primers, and 100 nM probe. Amplification parameters were 30 minutes at 48° C., 10 minutes at 95° C., and 40 cycles of 15 seconds at 95° C., and 1 minute at 60° C. RNA dilutions isolated from a HCoV EMC stock were used as a standard. Results are shown in FIGS. 17, 24, 25 and 26.

Example 13

HCoV EMC and SARS CoV S1 Fc proteins (2.5 μg) were mock incubated or incubated with 12.5 μg soluble DPP IV (sDPP IV) or soluble ACE2 (sACE2) in a total volume of 100 μl PBS. Precipitates were washed thrice with lysis buffer and once with PBS, and subjected to a NOVEX® 4 12% Tris Glycine gradient gel (Invitrogen) under non reducing conditions. Results are shown in FIG. 22.

Identification of DPP4 Using Mass Spec Analysis of Peptide Fragments

Example 14

1D SDS PAGE gel lanes were cut into ~1 mm slices (indicated as nr. 2 in FIG. 3) using an automatic gel slicer and subjected to in gel reduction with dithiothreitol, alkylation with chloroacetamide and digestion with trypsin (Promega, sequencing grade), essentially as described by Van den Berg et al. (Cell Stem Cell 6:369, included herein by reference). Alternatively, immunoprecipitated proteins were reduced and alkylated on beads similarly as described above. Nanoflow LC MS/MS was performed on either an 1100 series capillary LC system (Agilent Technologies) coupled to an LTQ Orbitrap XL mass spectrometer (Thermo), or an EASY nLC coupled to a Q Exactive mass spectrometer (Thermo), operating in positive mode and equipped with a nanospray source. Peptide mixtures were trapped on a ReproSil C18 reversed phase column (Dr Maisch GmbH; column dimensions 1.5 cm×100 μm, packed in house) at a flow rate of 8 al/minute. Peptide separation was performed on ReproSil C18 reversed phase column (Dr Maisch GmbH; column dimensions 15 cm×50 μm, packed in house) using a linear gradient from 0 to 80% B (A=0.1% formic acid; B=80% (v/v) acetonitrile, 0.1% formic acid) in 70 or 120 minutes and at a constant flow rate of 200 nl/minute. The column eluent was directly sprayed into the ESI source of the mass spectrometer. Mass spectra were acquired in continuum mode; fragmentation of the peptides was performed in data dependent mode by CID or HCD. Peak lists were automatically created from raw data files using the Mascot Distiller software (version 2.3; MatrixScience) or Proteome Discoverer (version 1.3; Thermo). The Mascot algorithm (version 2.2; MatrixScience, UK) was used for searching against a Uniprot database (release 2012_10. fasta, taxonomy: *Homo sapiens*, or *Macaca mulatta*, or *Myotis lucifugus*, or *Chlorocebus sabaeus*, or *Felis catus*, included herein by reference). The peptide tolerance was set to 10 ppm and the fragment ion tolerance was set to 0.8 Da for CID spectra (LTQ Orbitrap) or to 20 mmu for HCD (Q Exactive spectra). A maximum number of two missed cleavages by trypsin were allowed and carbamidomethylated cysteine and oxidized methionine were set as fixed and variable modifications, respectively. Results are shown in FIG. 21.

Inhibition of HCoV EMC Replication in Huh7 Cells by Antibodies to DPP4

Example 15

Huh7 cells were incubated with 20 μg/ml goat polyclonal antiserum against DPP4, a goat antiserum against ACE2, normal goat serum or left untreated. After 1 hour incubation, the cells were infected with HCoV EMC at a multiplicity of infection of 0.01 and left for 1 hour. Cells were washed twice and again incubated with medium containing the respective antibodies. Supernatant collected at 2 hours (open bars) and 20 hours (closed bars) was tested for presence of HcoV using a Taqman assay. Results are shown as A Ct in FIG. 25.

Blocking of DPP4-S1 Binding by Antibodies Directed Against S1

Example 16

Serum from a macaque infected with HCoV EMC inhibits binding of recombinant S1 to Huh7 cells. Serum at a dilution of 1:20, obtained from macaques at day 0 (blue line) and day 14 (red line) after infection with 5×107 TCID50 HCoV EMC, was preincubated for 1 hour at room temperature with 1.25 μg/ml recombinant S1 protein that was biotinylated and subsequently incubated on Huh7 cells. After treatment with FITC labeled streptavidin, cells were analyzed for fluorescence. In gray background, binding using a control biotinylated protein is shown (FIG. 26).

Crystallization and Crystals Comprising a DPP Fragment and a Viral Protein Fragment Example 17

One aspect of the present invention relates to methods for forming crystals comprising fragments of DPP and viral protein as well as crystals comprising fragments of DPP and viral protein. Crystallization of DPP is essentially known from, for example, U.S. Pat. No. 7,344,852 or U.S. Patent Publication 2005/0260723 that are included herein by reference.

In one embodiment of the present invention, a method for forming crystals comprising fragments of DPPIV and viral protein is provided comprising forming a crystallization volume comprising fragments of DPPIV and viral protein, one or more precipitants, optionally a buffer, optionally a monovalent and/or divalent salt and optionally an organic solvent; and storing the crystallization volume in a container under conditions suitable for crystal formation.

In yet another embodiment, a method for forming crystals comprising fragments of DPPIV and viral protein is provided comprising forming a crystallization volume comprising fragments of DPPIV and viral protein in solution comprising PEG precipitant listed hereinbelow; and storing the crystallization volume in a container under conditions suitable for crystal formation. PEG precipitant 5 50% w/v of precipitant, wherein the precipitant comprises one or more members of the group consisting of PEG MME having a molecular weight range between 300 10000, and PEG having a molecular weight range between 100 10000 pH 5 9. Buffers that may be used include, but are not limited to, tris, bicine, cacodylate, acetate, citrate, MES and combinations thereof. Additives optionally 0.05 to 0.8 M additives wherein the additives comprises sarcosine or 0.5% to 25% additives wherein the additives comprises xylitrol; Protein Concentration 1 mg/ml 50 mg/ml; Temperature 1° C. to 25° C.

In yet another embodiment, a method for forming crystals comprising fragments of DPPIV and viral protein is provided comprising forming a crystallization volume comprising fragments of DPPIV and viral protein; introducing crystals comprising fragments of DPPIV and viral protein as nucleation sites, and storing the crystallization volume under conditions suitable for crystal formation.

Crystallization experiments may optionally be performed in volumes commonly used in the art, for example, typically 15, 10, 5, or 2 microliters or less. It is noted that the crystallization volume optionally has a volume of less than 1 microliter, optionally 500, 250, 150, 100, 50 or less nanoliters.

It is also noted that crystallization may be performed by any crystallization method including, but not limited to, batch, dialysis and vapor diffusion (e.g., sitting drop and hanging drop) methods. Micro and/or macro seeding of crystals may also be performed to facilitate crystallization.

In one variation, crystals comprising DPPIV are formed by mixing a substantially pure DPPIV fragment and a substantially pure S1 HCoV EMC fragment with an aqueous buffer containing a precipitant at a concentration just below a concentration necessary to precipitate the proteinaceous substance. One suitable precipitant for crystallizing fragments of DPPIV and viral protein is polyethylene glycol (PEG), which combines some of the characteristics of the salts and other organic precipitants (see, for example, Ward et al., J. Mol. Biol. 98:161, 1975, and McPherson, J. Biol. Chem. 251:6300, 1976.

During a crystallization experiment, water is removed by diffusion or evaporation to increase the concentration of the precipitant, thus creating precipitating conditions for the protein. In one particular variation, crystals are grown by vapor diffusion in hanging drops or sitting drops. According to these methods, a protein/precipitant solution is formed and then allowed to equilibrate in a closed container with a larger aqueous reservoir having a precipitant concentration for producing crystals. The protein/precipitant solution continues to equilibrate until crystals grow.

By performing submicroliter volume sized crystallization experiments, as detailed in U.S. Pat. No. 6,296,673, effective crystallization conditions for forming crystals of fragments of DPPIV and viral protein complex are obtained. In order to accomplish this, systematic broad screen crystallization trials are performed on a DPPIV/viral protein fragment complex using the sitting drop technique.

One skilled in the art will recognize that the crystallization conditions provided herein can be varied and still yield protein crystals comprising fragments of DPPIV and viral protein. As the conditions for the crystallization, physical and chemical factors such as a hydrogen ion concentration (pH), a kind of buffer used and a concentration thereof, a kind of a precipitant added and a concentration thereof, protein concentration, salt concentration, temperature and the like can be involved. A method for controlling and investigating the factors includes batch methods, dialysis methods, vapor diffusion methods (hanging drop method, sitting drop method and the like), described, for instance, in T. L. Blundell et al., PROTEIN CRYSTALLOGRAPHY, 59 82 (1976), published by Academic Press, or the like.

The method for crystallization includes the batch methods, dialysis methods, vapor diffusion methods and the like. By the above method, physical and chemical factors such as a hydrogen ion concentration (pH), a kind and a concentration of the buffer used, and a kind and a concentration of the precipitant used, and physical and chemical factors such as protein concentration, salt concentration and temperature can be also determined.

The hydrogen ion concentration (pH) can be adjusted with a buffer. It is desired that the buffer is a buffer having buffering action in a broad range of pH, and being capable of suppressing precipitation of a non proteinous crystal between the co existing ion in the solution used during crystallization and the precipitant or the like. The buffer includes Tris hydrochloric acid buffer, phosphate buffer, cacodylate buffer, acetate buffer, citrate buffer, glycine buffer and the like.

The precipitant may be a substance capable of elevating an effective concentration of the protein or changing a hydrogen ion concentration (pH) of the protein solution. Generally, the precipitant includes salts such as ammonium sulfate, sodium sulfate, sodium phosphate, potassium phosphate, sodium citrate, ammonium citrate, sodium chloride, potassium chloride and ammonium chloride; polyethylene glycols having various average molecular weights of about 200, about 1000, about 2000, about 4000, about 6000, about 8000, about 20000 or the like; organic solvents such as 2 methyl 2,4 pentadiol, methanol, ethanol, isopropanol, butanol and acetone, and the like.

The protein concentration may be a concentration suitable for crystallization, and it is desired that the protein concentration is, for example, 1 to 50 mg/ml, preferably 5 to 20 mg/ml, more preferably 7 to 15 mg/ml.

It is desired that the temperature conditions are 3° C. to 25° C., preferably 12° C. to 22° C.

In the case where the crystallization is carried out by the batch method, the crystallization can be carried out by gradually adding a precipitant solution comprising a precipitant, buffer and the like, so as to form a layer on the top layer of the solution containing the dipeptidyl peptidase to give a mixture, or by gradually adding the solution comprising the DPPIV/viral protein fragment complex, so that the solution is an upper layer of the precipitant solution to give a mixture. Here, the mixture is allowed to stand in a tightly closed vessel or container. In the case where the crystallization is carried out by the dialysis method, the crystallization can be carried out by placing a solution comprising DPPIV/viral protein fragment complex in a size exclusion semi permeable membrane, and placing a precipitant solution outside of the size exclusion semi permeable membrane as a reservoir solution, thereby diffusing the reservoir solution to the solution comprising the DPPIV/viral protein fragment complex via the semi permeable membrane.

In the case where the crystallization is carried out by the hanging drop method in the vapor diffusion method, the crystallization can be carried out by placing a mixed solution of a solution comprising the DPPIV/viral protein fragment complex and a precipitant solution in a closed vessel allowing to be hanged at a position above the upper space of a reservoir in which the precipitant solution is contained as a reservoir solution, wherein the vapor pressure of the reservoir solution in the reservoir is set to be lower than that of the mixed solution.

In the case where the crystallization is carried out by the sitting drop method in the vapor diffusion method, the crystallization can be carried out by placing a mixed solution comprising a solution comprising the DPPIV/viral protein fragment complex and a precipitant solution in a closed vessel at a position higher than the liquid surface of a reservoir in which the precipitant solution is contained as a reservoir solution, wherein the vapor pressure of the reservoir solution in the reservoir is set to be lower than that of the mixed solution.

The crystallization can be carried out by the sitting drop method from the viewpoint of obtaining excellent quality and large crystals.

Crystals comprising fragments of DPPIV and viral protein have a wide range of uses. Such crystals may, for example, be used to perform X ray or neutron diffraction analysis in order to determine the three dimensional structure of fragments of DPPIV and viral protein and, in particular, to assist in the identification of its active site where fragments may bind. Knowledge of the binding site region allows rational design and construction of ligands including inhibitors. Crystallization and structural determination of fragments of DPPIV mutants and/or viral protein mutants having altered bioactivity allows the evaluation of whether such changes are caused by general structure deformation or by side chain alterations at the substitution site.

Example 18

Because DPPIV protein levels may not always accurately reflect the levels of active DPPIV enzyme, it may be useful to measure DPPIV enzymatic activity in proteinaceous substances instead. Use of a test system that is tested for DPPIV assay in proteinaceous substances as diverse as plasma, serum, urine, saliva, tissue, live cells and cell extracts, and exudates is recommended. Such a test system may be the DPPIV/CD26 Activity Assay for Biological Samples provided by ENZO® life sciences (on the World Wide Web at enzolifesciences.com). A known DPPIV inhibitor, such as P32/98 (Ki=130 nM) is preferably included for use as a control.

Example 19

To examine if cytokines decrease susceptibility to HCoV EMC infection through an effect on cell surface DPP4 expression, we analyzed DPP4 expression after treatment with different cytokines.

All treatments were done in quadruplets (96 well experiments) or triplicate (6 well and 24 well experiments). Cell cultures were grown for 24 to 48 hours and then changed to medium containing 1% newborn calf serum, and treated with recombinant human (r hu) IL 4 (BD Pharmingen), r hu IFN y, r hu TNF a, r hu IL 13, r hu IL 10, r hu IL 1, r hu TGF beta (Peprotech Inc.) and r hu IFN a (Roche) at a concentration of 10 ng/ml, 48 hours before infection for a further evaluation of changes in DPPIV surface protein expression and changes in susceptibility to HCoV EMC infection. In a first experiment, r hu TGF beta down regulates DPP4 expression and reduces the cells' susceptibility to virus infection and reduces virus replication.

Example 20

To examine if a compound decreases susceptibility to HCoV EMC infection through an effect on cell surface DPP4 expression, we analyze DPP4 expression after treatment with different compounds. Huh 7 cells are grown in Dulbecco's modified Eagle's medium (DMEM), supplemented with 10% fetal bovine serum (FBS), sodium bicarbonate and 20 mM HEPES buffer. All treatments are done in quadruplets (96 well experiments) or triplicate (6 well and 24 well experiments). Cultures are grown for 24 to 48 hours and then changed to medium containing 1% newborn calf serum, and treated with compound, i.e., adenosine (300 µM) or control vehicle for a further 48 hour evaluation of changes in DPPIV surface protein expression and changes in susceptibility to HCoV EMC infection. In a first experiment, adenosine down regulates DPP4 expression and reduces the cells' susceptibility to virus infection and reduces virus replication.

In a second experiment, inhibition of HCoV EMC replication in Huh7 cells by soluble adenosine deaminase (ADA) was demonstrated where inhibition with ACE2 was negative. Huh7 cells were incubated with different concentrations of recombinant soluble ADA or recombinant soluble ACE2. After 1 hour incubation, the cells were infected with HCoV EMC at a multiplicity of infection of 0.01. After 8 hours, cells were fixed and stained with a rabbit antiserum against HCoV EMC nsp4 and cells were counted. Results are shown as number of infected cells per well. Infection of Huh7 cells is inhibited by recombinant soluble ADA but not by recombinant soluble ACE2. The results are shown in FIG. 27.

In a third experiment, inhibition of HCoV EMC replication in Huh7 cells by soluble DPP4 was demonstrated. Different concentrations of recombinant soluble DPP4 or recombinant soluble ACE2 were incubated with HCoV EMC for 1 hour at 37° C. and used to infect Huh7 cells. After 8 hours, cells were fixed and stained with a rabbit antiserum against HCoV EMC nsp4 and cells were counted. Results are shown as number of infected cells per well. Infection of Huh7 cells is inhibited by recombinant soluble DPP4 but not by recombinant soluble ACE2. The results are shown in FIG. 28.

Example 21

The spike (S) protein of the recently emerged human coronavirus (MERS CoV) mediates infection by binding to the cellular receptor dipeptidyl peptidase 4 (DPP4). Here, we mapped the receptor binding domain in the S protein to a 231 amino acid fragment (residues 358 588) by evaluating the interaction of spike truncation variants with receptor expressing cells and soluble DPP4.

Antibodies to this domain much less so to the preceding N terminal region efficiently neutralize MERS CoV infection. It is herein now also shown by co immunoprecipitation and FACS analyses that an internal region of the S1 of hCoV EMC consisting of 231 amino acids is sufficient to bind its receptor, DPP4. It was also shown that the region elicits the most neutralizing antibodies against the virus. Those results identified the receptor binding region of the S protein by convincing methods and the region contains major neuralization epitopes.

Additionally, the inventors herein further map the receptor binding domain (RBD) in the spike protein of the novel coronavirus EMC (hCoV EMC, now MERS CoV). Based on data obtained with bioinformatic tools they designed truncation variants of the S1 portion of hCoV EMC S (EMC S) and showed that the S1 variant harboring residues 358 588 i) co purifies with recombinant CD26 (the hCoV EMC receptor), binds to cellular CD26 in a FACS based assay and elicits neutralizing antibodies in immunized rabbits with higher efficiency than the wt S1 subunit.

Just 10 years following the outbreak of the severe respiratory acute syndrome coronavirus (SARS CoV), the world is confronted with yet another deadly human coronavirus. The virus, first provisionally called human coronavirus EMC (hCoV EMC) but now named MERS CoV, referring to its emergence in the Middle East and to the respiratory syndrome it causes, belongs to the *betacoronavirus* genus lineage 2c. It has thus far been identified in over 50 patients from or linked to the Arabian Peninsula, approximately half of them being fatal. Like with SARS CoV, patients affected by MERS CoV suffer from severe and often lethal lower respiratory tract infection. The epidemiology of MERS CoV is still enigmatic, but the geographical distribution of epidemiologically unlinked individuals points to intermittent, zoonotic transmission from a—so far unknown animal source, whereas a number of reported clusters indicate limited human to human spread.

The main determinant of coronavirus tropism is the viral spike (S) protein as it mediates binding to a cell surface receptor. The MERS CoV S protein, a 1353 amino acid type I membrane glycoprotein, assembles into trimers that constitute the spikes or peplomers on the surface of the enveloped coronavirus particle. The protein combines the two essential entry functions, namely that of host receptor binding and membrane fusion, which are attributed to the N terminal (S1, residues 1 751) and C terminal (S2, residues 752 1353) half of the S protein, respectively. Recently, we have identified dipeptidyl peptidase 4 (DPP4, also known as CD26), expressed in the human lung, as a functional receptor for MERS CoV. Importantly, MERS CoV can also use the evolutionary conserved DPP4 of other species, most notably that of bats.

Coronaviruses bind to receptors via independently folded, generally about 150 300 residues long, receptor binding domains (RBD) present in their S1 subunit, of which the location within S1 can vary. Thus, for the *betacoronavirus* mouse hepatitis virus (MHV), the binding to its CEACAM receptor has been mapped to the N terminal ~300 amino acids of the spike protein whereas for the SARS CoV of the same genus binding to the ACE2 receptor maps to residues 323 502 of S1. Identification of the RBD can hence help the development of monoclonal antibodies and vaccines for the treatment and prevention of infection. The RBD is the most important target for neutralizing antibodies preventing virus receptor interaction.

We previously used the S1 domain of MERS CoV fused to the Fc region of human IgG to demonstrate the interaction of S1 with DPP4 expressing cells and with soluble, i.e., non membrane anchored DPP4. To identify the receptor binding domain in the MERS CoV S1 subunit, we generated S1 Fc protein chimeras with truncations at the C terminus and N terminus of the S1 domain. We considered a three domain structure of the MERS CoV S1 protein (residues 1 357, 358 588 and 589 747) based on the predicted location and structure of the RBD of two other *betacoronaviruses*, MHV and SARS CoV, of which the homologous regions for MERS CoV S map to the residues 18 351 and 379 580, respectively. In addition, a soluble form of human DPP4 (residues 39 766) was made, which was C terminally tagged with the Fc region. These proteins were expressed in HEK 293T cells after transfection of the expression plasmids and subsequently affinity purified from the cell culture supernatant using protein A sepharose beads as described. The Fc region of purified sDPP4 Fc was proteolytically removed using trypsin (data not shown). First, we analyzed the S1 Fc proteins and C terminal S1 truncations thereof for their ability to interact with sDPP4 using a co purification assay. sDPP4 was efficiently co purified by the S1 Fc variants encompassing residues 1 588 and 1 747, whereas the 1 357 S1 Fc variant was unable to bind sDPP4. We next generated an S1 Fc variant comprising residues 358 588, a region homologous to the ACE2 receptor binding domain in SARS CoV S1. This S1 Fc truncation variant efficiently bound soluble DPP4, indicating that the DPP4 receptor binding domain is located within the 358 588 residues domain of the MERS CoV spike protein.

We subsequently tested the ability of these S1 Fc variants to bind to HEK 293T cells transiently expressing DPP4 by using flow cytometry. The S1 Fc variants encompassing residues 1 588 and 358 588 bound to DPP4 expressing HEK 293T cells with efficiencies comparable to the full length S1 protein, whereas no binding was observed with the 1 357 S1 Fc variant. These data show the 358 588 amino acids S1 region to be essential and sufficient for binding to DPP4 expressing cells, consistent with the results of the sDPP4 interaction study.

Finally polyclonal antibodies were raised in rabbits against the 1 747, 1 357 and 358 588 S1 Fc variants (Davids Biotechnology GmbH, Germany). The sera, which displayed equal ELISA titers towards its antigen (1:300,000, data not shown), were tested for their ability to neutralize virus infectivity. Antibodies raised against the 358 588 S1 Fc variant efficiently neutralized virus infectivity, superior to those raised against the 1 747 and 1 357 S1 Fc variants. This indicates that neutralizing epitopes within S1 are primarily localized to the RBD region. The elicited antibodies are likely to block the interaction of the spike protein with DPP4 thereby neutralizing MERS CoV infectivity. The results demonstrate the preferred potential of S1 protein and of the 358 588 S1 polypeptide or functional fragments thereof reactive with the MERS CoV neutralizing antibody for use as subunit vaccines with a high biosafety profile compared to vaccines based on inactivated viruses or live attenuated virus.

Except for the *betacoronavirus* MHV, which binds to its CEACAM receptor through a domain in the N terminal part of its S1 protein, the RBDs of all other coronaviruses that engage protein receptors and that have been mapped occur in the C terminal portion of the S1 subunit. Examples also include the *alphacoronaviruses* binding to ACE2 (hCoV NL63) and APN (e.g., TGEV, hCoV 229E). In this study, we have experimentally mapped the RBD of MERS CoV to a 231 amino acid fragment (residues 358 588) within the spike protein. This domain nicely corresponds with the S1 region recently anticipated to interact with the DPP4 receptor on the basis of theoretical S1 structure predictions. The RBD in the MERS CoV S1 protein localizes in the same region where the SARS CoV S protein interacts with its ACE2 receptor. The SARS CoV RBD structure displays a five stranded β sheet core structure (β1 4 and β7) maintaining the overall domain conformation, and a long extended loop containing two anti parallel β sheets (β5 and β6) responsible for receptor binding{{ }}. Intriguingly, compared to SARS CoV, the RBD of MERS CoV contains a relatively conserved core domain but a highly variable loop region, tentatively explaining the differential receptor usage. Crystallization and structure analysis of this MERS CoV RBD region in complex with DPP4 will give detailed insight into the virus receptor binding interface.

Example 22

Dipeptidyl Peptidase 4 Receptor Determinants of Respiratory MERS-Coronavirus Infection Here we show that MERS coronavirus (MERS-CoV) replicates in cells of different species using dipeptidyl peptidase 4 (DPP4) as a functional receptor. This suggests a broad host species tropism allowing zoonotic transmission from many animal species. Here we show contrasting DPP4 receptor functionality in different animal species. Resistance of ferrets to MERS-CoV infection was due to the inability to bind MERS-CoV as a result of amino acid variation in the ferret DPP4 β-propeller region. In contrast, DPP4 expressing respiratory epithelial cells in the lower—but not upper—respiratory tract of cynomolgus macaques were targeted by MERS-CoV, which resulted in relatively mild disease. Variable DPP4 expression and adenosine deaminase (ADA)—shown to act as a natural antagonist for MERS-CoV infection—may potentially modulate MERS-CoV infection. Our findings illuminate the role of DPP4 sequence and expression variability in host range restriction and outcome of respiratory MERS-CoV infection and lead us to conclude that MERS-CoV receptor sequence and expression variability determine host range restriction of lower respiratory MERS-CoV infection.

Coronaviruses (CoVs) usually cause common colds in humans but zoonotic transmission occasionally introduces more pathogenic viruses into the human population as was demonstrated by the severe acute respiratory syndrome (SARS) outbreak. In 2012 a previously unknown human coronavirus (CoV), now named Middle East respiratory syndrome CoV (MERS-CoV), was isolated from the sputum of a 60-year-old man in Saudi Arabia who presented with acute pneumonia with a fatal outcome. To date, several infection clusters have been reported over a one-year period with around 50% of the reported human cases being fatal. Although limited human-to-human transmission has been observed, it is feared that by acquiring additional mutations MERS-CoV may spread more easily.

MERS-CoV represents a novel *betacoronavirus* species with the closest known relatives being clade 2c bat CoVs, detected in diverse species of bats but not yet in any animal species from the Arabian Peninsula. Although MERS-CoV replicates in cells of different species including bats, pigs and (non-) human primates, its ability to infect different animal species may be restricted given the fact that hamsters were shown to resist MERS-CoV infection. Therefore, a further understanding of factors that determine host restriction and viral transmission need to be revealed by studies in different animal species.

Figure 33A:
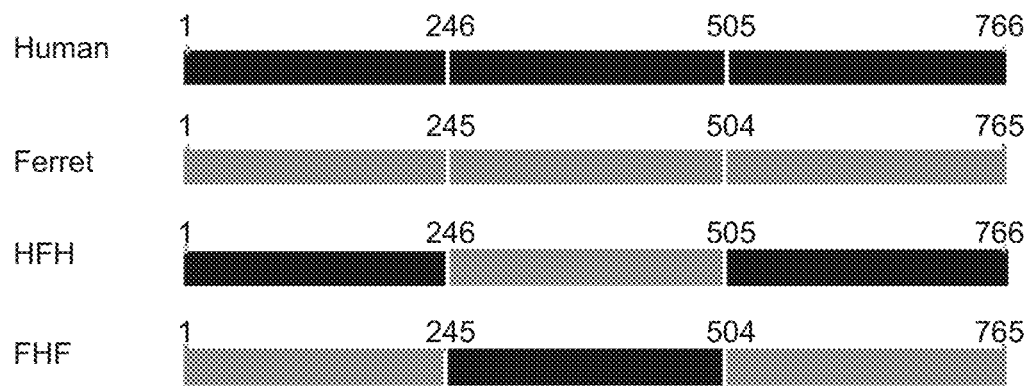
Figure 33B:
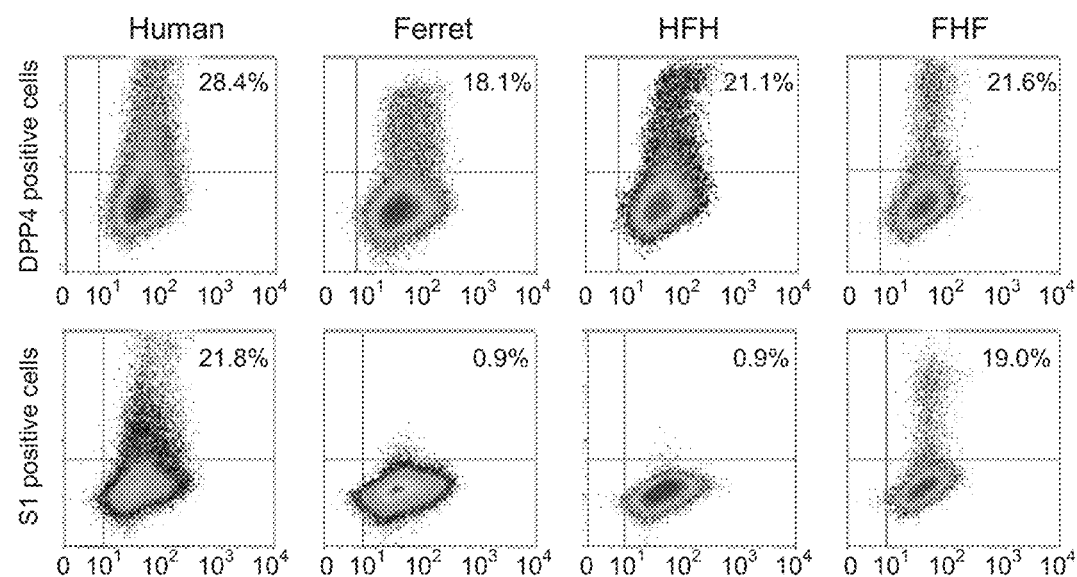
Figure 33D:
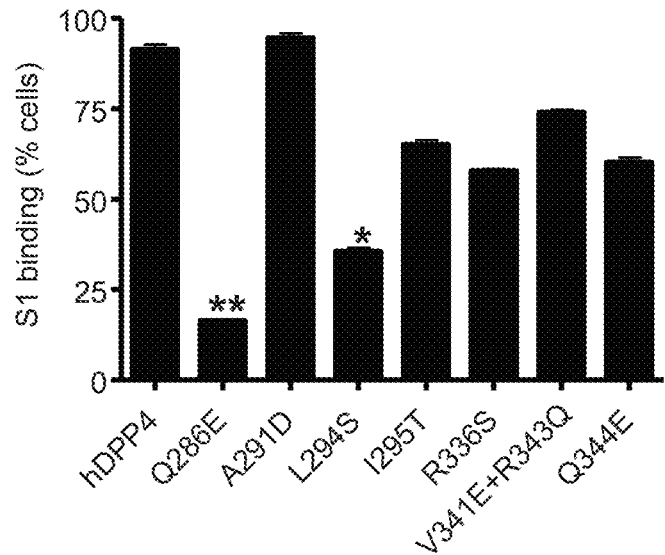
Figure 33E:
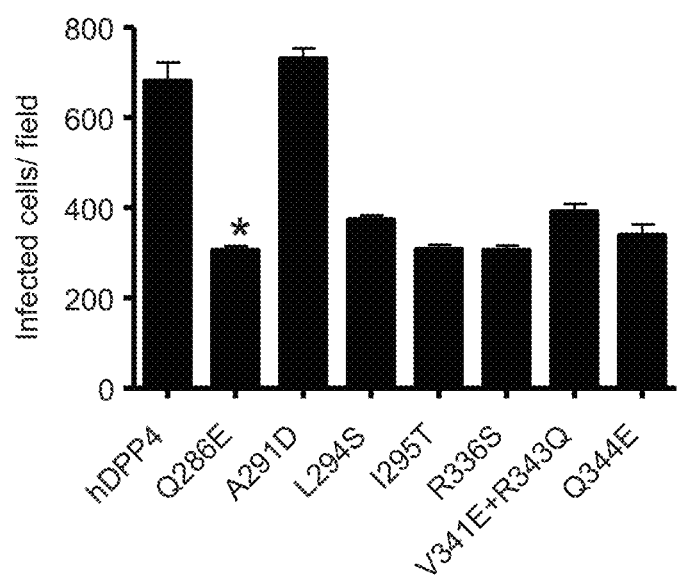

Herein we identified dipeptidyl peptidase 4 (DPP4) as a functional MERS-CoV receptor in human and bat cells. To further analyse DPP4 usage by MERS-CoV in vivo, ferrets (n=4), known to be susceptible to several respiratory viruses including SARS-CoV and influenza viruses, were inoculated intratracheally with MERS-CoV. The animals did not seroconvert and only low levels of virus were detected by RT-qPCR in respiratory swabs at 1-2 days post infection (dpi). In vitro, ferret primary kidney cells could not be infected with MERS-CoV despite DPP4 surface expression, while transfection of these cells with human DPP4 (hDPP4) rendered the cells susceptible, suggesting that ferret DPP4 (fDPP4) does not efficiently bind MERS-CoV. Consistently, MDCK cells transfected with fDPP4 did not bind to synthetic MERS-CoV spike (S1) protein and were not infected by the virus (FIG. 33B,C). DPP4 is an ectoenzyme that cleaves dipeptides from hormones, chemokines and cytokines by its conserved C-terminal ca-hydrolase domain of the protein, while its N-terminal eight-blade β-propeller domain contains more sequence variability. By constructing DPP4 chimeras we observed that the blades 4 and 5 containing hDPP4 domain (residues 246-505) could confer to ferret DPP4 the ability to bind to S1 and to mediate MERS-CoV infection when expressed in non-susceptible cells (FIG. 33B,C). A Quick Change site-directed mutagenesis kit (Stratagene) was used to construct different hDPP4 point mutants. The presence of the correct mutations and absence of undesired mutations was confirmed by sequencing analysis. Plasmids were transfected into MDCK cells in triplicate, after 24 h incubation individual wells were split to determine DPP4 cell surface expression, S1-binding and susceptibility to MERS-CoV infection on the same transfected cell culture. Consistently, substitution of selected solvent exposed residues present in blades 4 and 5 of hDPP4 by those occurring at these positions in fDPP4, abrogated DPP4's capacity to bind to S1 and to mediate MERS-CoV cell susceptibility upon transfection, suggesting that these residues are involved in MERS-CoV binding and entry (FIG. 33D,E). Reciprocal substitutions of these amino acids in fDPP4 however, did not confer S1 binding, demonstrating the complexity of the interaction in the face the highly polymorphic nature of these two blades. The identified residues also are critical in binding the human enzyme adenosine deaminase (ADA), a natural DPP4 ligand that is involved in the development and maintenance of the immune system. Using recombinant ADA, significant inhibition of MERS-CoV infection and spike protein binding was demonstrated revealing a natural occurring antagonist able to block MERS-CoV infection. The data on the co-crystallization of the receptor binding domain of S1 and DPP4 are in line with the data presented. Phylogenetic analysis of the virus binding region of DPP4 indicated that human, macaque, horse and rabbit DPP4 cluster together as do DPP4's from cattle, pig and bats, that are somewhat more distantly related. Small animals including ferret, mice and most likely hamsters, shown to resist MERS-CoV infection, are more divergent in the DPP4 virus binding region, which at least in the case of ferrets has consequences for MERS-CoV binding.

Considering the highly conserved virus binding region in macaque DPP4 as compared to hDPP4, we first confirmed the use of cynomolgus macaque DPP4 as a functional MERS-CoV receptor. DPP4 antibodies blocked MERS-CoV infection of macaque primary kidney cells in vitro. Besides macaques, rabbits may be a potential animal model for MERS-CoV infection; ex vivo inoculation of rabbit lung and kidney tissues revealed susceptibility to MERS-CoV. We subsequently inoculated ten young adult cynomolgus macaques intratracheally with MERS-CoV and euthanized them at 1 (n=4, macaques 1-4), 4 (n=4, macaques 5-8) and 28 dpi (n=2, macaques 9 and 10). All animals remained free of severe clinical signs and maintained a rhythmic pattern of body temperatures fluctuating between 35° C. (night) and 39° C. (day) that seemed slightly elevated after inoculation. Neutralizing antibodies with titers 40-80 were detected in the two MERS-CoV infected macaques that were euthanized at 28 dpi. Upon necropsy, there were a few mild focal red-grey slightly depressed areas affecting less than 5% of the lung tissue, although one lobe of macaque 7 had a dark red rim with evidence of suppurative bronchopneumonia, consistent with the detection of *Escherichia coli* bacteria in this lobe. MERS-CoV mRNA was detected at highly variable levels in pharyngeal and nasal swabs on 1 to 11 dpi and at low levels in rectal swabs on 2 and 3 dpi. In addition, MERS-CoV was detected by RT-qPCR in the lungs, nasal septum, serum and spleen and in one animal—macaque 1—also in the kidney, liver, colon and urine at 1 dpi. Infectious virus was detected only in one pharyngeal swab sample and to a limited extent in the lungs. Using a probe that targets the MERS-CoV nucleocapsid gene, hybridization was observed in epithelial cells in bronchioles, and in moderate numbers of type 2 and few type 1 pneumocyte-resembling cells in the alveoli at 1 dpi while at 4 dpi very few cells were found positive. Consistent with activation of cytokines like CCL3, the lungs showed mild alveolitis, characterized by thickening of the alveolar septa with infiltration of few neutrophils and macrophages and moderate type 2 hypertrophy and hyperplasia at 4 dpi. In the alveolar lumina there were increased numbers of alveolar macrophages and occasionally small amounts of edematous fluid with fibrin and few neutrophils. Consistent with the capacity of the virus to induce syncytia in vitro, syncytial cells were seen. By applying a technique that enables successive staining of the same tissue section, tropism of MERS-CoV for cells expressing DPP4 in vivo was demonstrated. Thus, the experimental infection of young adult macaques with MERS-CoV revealed that macaque DPP4 positive cells in the lower respiratory tract can be infected with MERS-CoV but the associated pathological changes are relatively mild, indicating that young adult macaques are at best a suboptimal MERS-CoV animal model for the often fatal MERS-CoV infection in humans.

Abundant ACE2 expression in the respiratory tract has been suggested to facilitate rapid spread of SARS-CoV, a critical factor in the rapid induction of innate immune responses that drive the acute respiratory distress syndrome. In non-infected macaques DPP4 expression was restricted to non-ciliated cells, type 2 cells and endothelial cells whereas no staining was observed in ciliated epithelial cells of the (upper) respiratory tract. The absence of DPP4 on the upper respiratory tract epithelial cells, consistent with the inability to detect viral antigen in these cells, therefore may limit efficient virus transmission through the upper respiratory route. Kidneys, liver, intestine, and sub mucosal glands of the upper respiratory tract were found to contain varying levels of DPP4, which mainly localized to the apical side of the cells. Enhanced DPP4 expression was observed in the lungs of the bacterial co-infected macaque 7, which excreted infectious virus in the pharyngeal swab and displayed a higher body temperature. We observed that LPS stimulation of in vitro differentiated macrophages enhanced DPP4 expression. Attempts to infect these cells were unsuccessful, likely due to ADA production by these cells. Interestingly, DPP4 was virtually absent in the lower respiratory tract epithelium of ferrets but could be visualized in the kidneys of these animals. Contrastingly, relatively strong DPP4 expression was observed on different cell types in human lungs, including a MERS-CoV infected individual. In several pathological conditions such as viral infections and type 2 diabetes increased levels of (soluble) DPP4 have been demonstrated. Thus, relatively low levels of DPP4 expression in the lungs of young adult macaques could partly explain the mild infection observed after MERS-CoV infection but further studies need to reveal the role of varying DPP4 and ADA expression levels in regulating MERS-CoV replication in vivo.

Our findings demonstrate that the host range potential of the emerging novel human MERS-CoV is primarily determined by the MERS-CoV binding to and tissue distribution of DPP4. The co-localisation of DPP4 with MERS-CoV in the lower respiratory tract of MERS-CoV infected non-human primates (in bronchioles and alveoli), and the inability to infect ferrets further supports the sole involvement of DPP4 as a functional receptor in MERS-CoV entry. Variable levels of DPP4 expression in the lower respiratory tract may impose MERS-CoV host range restriction and explain why studies in rhesus macaques have not been successful to reproduce the severe disease seen in humans. Future studies need to unravel the significance of variable DPP4 expression in MERS-CoV patients, for example as a result of co morbidities like microbial infections, type 2 diabetes or aging.

Material and Methods

Cloning of Human and Ferret DPP4.

The hDPP4 cDNA was obtained as described. Total RNA was isolated from ferret primary kidney cells using RNeasy mini kit (Qiagen) and cDNAs were synthesized by using the Superscript reverse transcriptase (Life Technologies). The complete DPP4 genes were amplified using Pfu Ultra II fusion HS DNA polymerase (Stratagene) and cloned into the pcDNA 3.1 expression vector (Life Technologies). Human to ferret DPP4 mutants of cDNA constructs were made by utilizing unique restriction enzyme sites shared by human and ferret DPP4. Pst I can cut human and ferret DPP4 into three fragments (human, amino acid 1-246, 247-504 and 505-766 and ferret, amino acid 1-245, 246-503 and 504-765). The middle fragment of human and ferret DPP4 was exchanged between human and ferret, the final plasmid constructs contained different combinations of fragments: human-ferret-human (HFH) or ferret-human-ferret (FHF). A Quick Change site-directed mutagenesis kit (Stratagene) was used to construct different hDPP4 point mutants. The presence of the correct mutations and absence of undesired mutations was confirmed by sequencing analysis. Plasmids were transfected into MDCK cells in triplicate, after 24 h incubation individual wells were split to determine DPP4 cell surface expression, S1-binding and susceptibility to MERS-CoV infection on the same transfected cell culture. S1 binding and infection were corrected for DPP4 cell surface expression as determined by the goat polyclonal antiserum against DPP4 (R&D systems), a secondary FITC conjugated rabbit anti goat serum followed by FACS analysis.

Phylogenetic Analysis of DPP4.

Sequence alignment was performed by using ClustalW in the MEGA5.0 software package (www.megasoftware.net), and the trees were constructed by using the neighbor-joining method with p-distance (gap/missing data treatment; complete deletion) and 1,000 bootstrap replicates as in MEGA version 5.0.

Protein Expression and S1 Binding Assay.

A plasmid encoding MERS-CoV S1-Fc was generated by ligating a fragment encoding the S1 domain (residues 1-747) 3'-terminally to a fragment encoding the Fc domain of human IgG into the pCAGGS expression vector. Likewise, an S1-Fc expression plasmid was made the FIPV S1 domain (isolate 79-1146; residues 1-788). Fc chimeric proteins were expressed by transfection of the expression plasmids into HEK-293T cells and affinity purified from the culture supernatant using Protein A Sepharose beads (GE Healthcare). S1 binding of cells was measured by incubating 105 cells with 15 mg/ml of S1-Fc followed by incubation with FITC or DyLight-488-labelled goat-anti-human IgG antibody and analysis by flow cytometry.

Virus Infection Experiments.

Virus stocks of MERS-CoV (EMC isolate) were prepared. Transfected COS-7 cells, Huh-7 and primary ferret and macaque kidney cells were inoculated with MERS-CoV for 1 h with high MOI. After washing the cells were incubated with medium containing 1% fetal bovine serum. Alternatively we used thin cut slices from the lungs and kidneys of rabbits that were incubated in culture medium with virus for 24 h. At 8 or 24 h after infection cells were fixed with formaldehyde and stained using rabbit-anti-SARS-CoV NSP4 antibodies that are cross-reactive for hCoV-EMC, according to standard protocols using a FITC conjugated swine-anti-rabbit antibody as a second step. Primary ferret or macaque kidney cells were preincubated with antibodies to DPP4 (polyclonal goat-anti DPP4 immunoglobulin, R&D systems) at 20 µg/ml to block MERS-CoV infection. Recombinant human ADA (R&D systems) was preincubated with hDPP4 transfected cells or Huh7 cells for 1 h after which the cells were infected with MERS-CoV for 8 h and processed.

Animal Studies.

Ten cynomolgus macaques (*Macaca fascicularis*), 3-5 years old with active temperature transponders in the peritoneal cavity (n=3), were inoculated with 5×106 TCID50 of MERS-CoV via the intranasal and intratracheal route. In addition, four ferrets (*Mustello fuoris*) were inoculated with 1×106 TCID50 of MERS-CoV via the intranasal and intratracheal route. Animals were checked daily for clinical signs. Just before infection and at different dpi, animals were anesthetized with ketamine and nasal, pharyngeal, and rectal swabs were taken, which were placed in 1 ml Dulbecco's modified Eagle's medium supplemented with 100 IU penicillin/ml and 100 □g of streptomycin/ml (virus transport medium) and frozen at −70° C. until RT-PCR analysis. The animals were euthanized at different days (Day 1, 4 or 28) p.i. by exsanguination under ketamine anesthesia. Approval for animal experiments was obtained from the Institutional Animal Welfare Committee (nr EMC 2808).

Necropsies were performed according to a standard protocol. For semi-quantitative assessment of gross pathology, the percentage of affected lung tissue from each lung lobe was determined at necropsy, recorded on a schematic diagram of the lung and the area of affected lung tissue was subsequently calculated (gross pathology score). One lung of each monkey was inflated with 10% neutral-buffered formalin by intrabronchial intubation and suspended in 10% neutral-buffered formalin overnight. Samples were collected in a standard manner (from the cranial, medial and caudal parts of the lung), embedded in paraffin, cut at 3 Om and used for immunohistochemistry (see below) or stained with hematoxylin and eosin (H&E). The lung, liver, spleen, kidney, intestine, trachea, and tracheobronchial lymphnode H&E sections were examined by light microscopy.

In Situ Hybridization.

The ISH probes targeting the nucleocapsid gene of MERS-CoV were designed by Advanced Cell Diagnostics (Hayward, Calif.) and ISH was performed according to the manufacturer's instructions and ISH staining was visualized using substrate Fast Red (pink). Controls included probes against SARS-CoV nucleocapsid protein and tissues from non infected animals.

Immunohistochemistry.

Family consent was granted for limited postmortem tissue retrieval from a MERS-CoV patient in the UK, consisting of a 20-cm-long midline incision in lower chest and upper abdomen, from which tissue samples were collected from both lungs. Archival paraffin-embedded human tissue sections were obtained from the Department of Pathology, Erasmus M C. Four historic macaque controls were used as mock (PBS) infected. For histological analysis, samples were placed in 10% neutral-buffered formalin and further processed for routine immunohistochemistry. Serial 3 µm lung sections were stained using according to standard protocols using antibodies to DPP4 (polyclonal goat-anti DPP4 immunoglobulin, R&D systems). For phenotyping to test DDP4 expression of MERS-CoV infected cells, we used a destaining-restaining technique. Briefly, the precipitate used for visualization of MERS-CoV antigen staining was dissolved in graded 100%-70% alcohols. To detach the primary antibody and red immunohistochemistry signals, slides were soaked in eluding buffer (5 ml 0.1M HCl, 95 ml 0.1M NaCl containing 1M glycine) for 2 hours. The sections were treated with two 5 min intervals heating in citric acid buffer pH 6.0 to denature any undetached primary antibody. The slides were then incubated with antibodies against DPP4 in PBS/0.1% BSA for 1 hour at RT. After washing, sections were incubated with horseradishperoxidase labeled anti-goat IgG 1/100 in PBS/0.1% BSA for 1 hour at RT. Peroxidase activity was revealed by incubating slides in 3,3'-diaminobenzidine-tetrachlorhydrate (DAB) (Sigma) for 3-5 minutes, resulting in a brown precipitate, followed by counterstaining with hematoxylin.

RNA-extraction and quantitative RT-PCR. Samples were analysed with the upE PCR and confirmed by a nucleocapsid specific PCR. RNA from 200 □l of culture supernatant was isolated with the Magnapure LC total nucleic acid isolation kit (Roche) and eluted in 100 □l. MERS-CoV RNA was quantified on the ABI prism 7700, with the TaqMan® Fast Virus 1-Step Master Mix (Applied Biosystems) using 20 □l isolated RNA, 1× Taqman mix, 0.5 U uracil-N-glycosylase, 45 pmol forward primer (5'-GGGTGTACCTCTTAATGC-CAATTC-3'; SEQ ID NO: 1), 45 pmol reverse primer (5'-TCTGTCCTGTCTCCGCCAAT-3'; SEQ ID NO: 2) and 5 pmol probe (5'-FAM-ACCCCTGCGCAAAATGCTGGG-BHQ1-3'; SEQ ID NO: 3). Amplification parameters were 5 min at 50° C., 20 sec at 95° C., and 45 cycles of 3 s at 95° C., and 30 sec at 60° C. RNA dilutions isolated from an MERS-CoV stock were used as a standard.

Lung tissue samples (0.3-0.5 gram) were taken for RT-PCR and microarray analysis in RNA-later (Ambion, Inc.). RNA was isolated from homogenized post mortem tissue samples using Trizol Reagent (Invitrogen) and the RNeasy mini kit (Qiagen). cDNA synthesis was performed with ~1 □g total RNA and Superscript III RT (Invitrogen) with oligo(dT), according to the manufacturer's instructions. Semi-quantitative RT-PCR was performed as described previously to detect MERS-CoV and to validate cellular gene expression changes as detected with microarrays of CCL3 (Applied Biosystems). Differences in gene expression are represented as the fold change in gene expression relative to a calibrator and normalized to a reference. GAPDH (glyceraldehydes-3-phosphate dehydrogenase) was used as endogenous control to normalize quantification of the target gene. The samples from the mock-infected macaques were used as a calibrator. Average results (□ s.e.m.) for groups were expressed as fold change compared to PBS-infected animals.

Macrophage Cultures.

Monocytes isolated from peripheral blood mononuclear cells were cultured with GM-CSF for 5 days to generate macrophages. Subsequently cells were stimulated with LPS at 1 μg/ml for 24 h and processed for DPP4 staining and FACS analysis.

Statistical Analysis.

Data were compared using one way ANOVA with post-test Bonferroni. Statistical analysis was performed with Prism 4.0 (Graphpad).

REFERENCES TO EXAMPLE 22

1. J. S. Peiris, Y. Guan, K. Y. Yuen, *Nat. Med.* 10, S88-97 (2004).
2. A. M. Zaki, S. van Boheemen, T. M. Bestebroer, A. D. Osterhaus, R. A. Fouchier, N. *Engl. J. Med.* 367, 1814-1820 (2012).

3. S. van Boheemen et al., *MBio* 3, 00473-12 (2012).
4. World Health Organisation. Middle East respiratory syndrome coronavirus (MERS-CoV)-update, http://www.who.int/csr/don/2013_08_01/en/index.html (8 Aug. 2013).
5. A. Assiri et al., *N. Engl. J. Med.* 369, 407-416 (2013).
6. B. Guery et al., *Lancet* 381, 2265-2272 (2013).
7. C. B. Reusken et al., *Vector Borne Zoonotic Dis* 10, 785-791 (2010).
8. A. Annan et al., *Emerg Infect Dis* 19, 456-459 (2013).
9. M. A. Muller et al., *MBio* 3, 00515-12 (2012).
10. J. F. Chan et al., *J. Infect. Dis.* 207, 1743-1752 (2013).
11. E. de Wit et al., *PLoS One* 8, e69127 (2013).
12. V. S. Raj et al., *Nature* 495, 251-254 (2013).
13. B. E. Martina et al., *Nature* 425, 915 (2003).
14. J. A. Belser, J. M. Katz, T. M. Tumpey, *Dis. Model. Mech.* 4, 575-579 (2011).
15. E. Boonacker, C. J. Van Noorden, *Eur. J. Cell. Biol.* 82, 53-73 (2003).
16. W. A. Weihofen, J. Liu, W. Reutter, W. Saenger, H. Fan, *J. Biol. Chem.* 279, 43330-43335 (2004).
17. R. P. Dong et al, *J. Immunol.* 156, 1349-1355 (1996).
18. G. Lu et al., *Nature* doi:nature12328 (2013).
19. N. Wang et al., *Cell.* Res. doi:cr201392 (2013).
20. B. Rockx et al., *J. Virol.* 83, 7062-7074 (2009).
21. S. L. Smits et al., *PLoS Pathog.* 6, e1000756 (2010).
22. J. Zhong et al., *Diabetes* 62, 149-157 (2013).
23. B. A. Conlon, W. R. Law, *Clin. Exp. Immunol.* 138, 14-20 (2004).
24. S. A. Lee et al., *J. Clin. Endocrinol. Metab.* 98, 2553-2561 (2013).
25. T. Andrieu et al., *J. Clin. Virol.* 27, 59-68 (2003).
26. V. J. Munster, E. de Wit, H. Feldmann, *N. Engl. J. Med.* 368, 1560-1562 (2013).
27. S. L. Smits et al., *J. Virol.* 85, 4234-4245 (2011).
28. V. M. Corman et al., *Euro. Surveil*.1 17, pii: 20334 (2012).

Applicants incorporate by reference the material contained in the accompanying computer readable Sequence Listing identified as Sequence Listing 078168 24 ST25.txt, having a file creation date of Jul. 11, 2016 10:07 A.M. and file size of 960 KB.

SEQUENCE LISTING (1143 sequences)

SEQ ID NO: 1 - DNA, 24 bp, Artificial Sequence
  primer
gggtgtacctcttaatgccaattc

SEQ ID NO: 2 - DNA, 20 bp, Artificial Sequence
  primer
tctgtcctgtctccgccaat

SEQ ID NO: 3 - DNA, 21 bp, Artificial Sequence
  primer
acccctgcgcaaaatgctggg

SEQ ID NO: 4 - DNA, 455 bp, Human coronavirus
ggggttgggactatcctaagtgtgatagagctatgcctaatatgtgtagaatcttcgcttcactcatattagctcgtaaacatggcacttgttgtactacaagggacagattttatcgcttggcaaatgagtgtgctcaggtgctaagcgaatatgttctatgtggtggtggttactacgtcaaacctggaggtaccagtagcggagatgccaccactgcatatgccaatagtgtctttaacattttgcaggcgacaactgctaatgtcagtgcacttatgggtgctaatggcaacaagattgttgacaaagaagttaaagacatgcagtttgatttgtatgtcaatgtttacaggagcactagcccagaccccaaatttgttgataaatactatgcttttcttaataagcacttttctatgatgatactgtctgacgacggcgttgtgtgttaa

SEQ ID NO: 5 - protein, 413 aa, Human coronavirus
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSLSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 6 - protein, 219 aa, Human coronavirus
MSNMTQLTEAQIIAIIKDWNFAWSLIFLLITIVLQYGYPSRSMTVYVFKMFVLWLLWPSSMALSIFSAVYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 7 - protein, 82 aa, Human coronavirus
MLPFVQERIGLFIVNFFIFTVVCAITLLVCMAFLTATRLCVQCMTGFNTLLVQPALYLYNTGRSVYVKFQDSKPPLPPDEWV

SEQ ID NO: 8 - protein, 107 aa, Human coronavirus
MAFSASLFKPVQLVPVSPAFHRIESTDSIVFTYIPASGYVAALAVNVCLIPLLLLLRQDTCRRSIIRTMVLYFLVLYNFLLAIVLVNGVHYPTGSCLIAFLVILIIL

SEQ ID NO: 9 - protein, 246 aa, Human coronavirus
MEESLMDVPSTSGTQVYSRKARKRSHSPTKKLRYVKRRFSLLRHEDLSVIVQPTHYVRVTFSDPNMWYLRSGHHLHSVHNWLKPYGGQPVSEYHITLALLNLTDEDLARDFSPIALFLRNVRFELHEFALLRKTLVLNASEIYCANIHRFKPVYRVNTAIPTIKDWLLVQGFSLYHSGLPLHMSISKLHALDDVTRNYIITMPCFRTYPQQMFVTPLAVDVVSIRSSNQGNKQIVHSYPILHHPGF

SEQ ID NO: 10 - protein, 109 aa, Human coronavirus
MDYVSLLNQIWQKYLNSPYTTCLYIPKPTAKYTPLVGTSLHPVLWNCQLSFAGYTESAVNSTKALAKQDAAQRIAWLLHKDGGIPDGCSLYLRHSSLFAQSEEEEPFSN

SEQ ID NO: 11 - protein, 103 aa, Human coronavirus
MRVQRPPTLLLVFSLSLLVTASSKPLYVPEHCQNYSGCMLRACIKTAQADTAGLYTNFRIDVPSAESTGTQSVSVDLESTSTHDGPTEHVTSVNLFDVGYSVN

SEQ ID NO: 12 - protein, 1353 aa, Human coronavirus
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFQKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 13 - protein, 7078 aa, Human coronavirus
MSFVAGVTAQGARGTYRAALNSEKHQDHVSLTVPLCGSGNLVEKLSPWFMDGENAYEVVKAMLLKKEPLLYVPIRLAGHTRHLPGPRVYLVERLIACENPFMVNQLAYSSSANGSLVGTTLQGKPIGMFFPYDIELVTGKQNILLRKYGRGGYHYTPFHYERDNTSCPEWMDDFEADPKGKYAQNLLKKLIGGDVTPVDQYMCGVDGKPISAYAFLMAKDGITKLADVEADVAARADDEGFITLKNNLYRLVWHVERKDVPYPKQSIFTINSVVQKDGVENTPPHYFTLGCKILTLTPRNKWSGVSDLSLKQKLLYTFYGKESLENPTYIYHSAFIECGSCGNDSWLTGNAIQGFACGCGASYTANDVEVQSSGMIKPNALLCATCPFAKGDSCSSNCKHSVAQLVSYLSERCNVIADSKSFTLIFGGVAYAYFGCEEGTMYFVPRAKSVVSRIGDSIFTGCTGSWNKVTQIANMFLEQTQHSLNFVGEFVVNDVVLAILSGTTTNVDKIRQLLKGVTLDKLRDYLADYDVAVTAGPFMDNAINVGGTGLQYAAITAPYVVLTGLGESFKKVATIPYKVCNSVKDTLAYYAHSVLYRVFPYDMDSGVSSFSELLFDCVDLSVASTYFLVRILQDKTGDFMSTIITSCQTAVSKLLDTCFEATEATFNFLLDLAGLFRIFLRNAYVYTSQGFVVVNGKVSTLVKQVLDLLNKGMQLLHTKVSWAGSKIIAVIYSGRESLIFPSGTYYCVTTKAKSVQQDLDVILPGEFSKKQLGLLQPTDNSTTVSVTVSSNMVETVVGQLEQTNMHSPDVIVGDYVIISEKLFVRSKEEDGFAFYPACTNGHAVPTLFRLKGGAPSKKVAFGGDQVHEVAAVRSVTVEYNIHAVLDTLLASSSLRTFVVDKSLSIEEFADVVKEQVSDLLVKLLRGMPIPDFDLDDFIDAPCYCFNAEGDASWSSTMIFSLHPVECDEECSEVEASDLEEGESECISETSTEQVDVSHETSDDEWAAAVDEAFPLDEAEDVTESVQEEAQPVEVPVEDIAQVVIADTLQETPVVPDTVEVPPQVVKLPSAPQTIQPEVKEVAPVYEADTEQTQNVTVKPKRLRKKRNVDPLSNFEHKVITECVTIVLGDAIQVAKCYGESVLVNAANTHLKHGGGIAGAINAASKGAVQKESDEYILAKGPLQVGDSVLLQGHSLAKNILHVVGPDARAKQDVSLLSKCYKAMNAYPLVVTPLVSAGIFGVKPAVSFDYLIREAKTRVLVVVNSQDVYKSLTIVDIPQSLTFSYDGLRGAIRKAKDYGFTVFVCTDNSANTKVLRNKGVDYTKKFLTVDGVQYYCYTSKDTLDDILQQANKSVGIISMPLGYVSHGLDLMQAGSVVRRVNVPYVCLLANKEQEAILMSEDVKLNPSEDFIKHVRTNGGYNSWHLVEGELLVQDLRLNKLLHWSDQTICYKDSVFYVVKNSTAFPFETLSACRAYLDSRTTQQLTIEVLVTVDGVNFRTVVLNNKNTYRSQLGCVFFNGADISDTIPDEKQNGHSLYLADNLTADETKALKELYGPVDPTFLHRFYSLKAAVHGWKMVVCDKVRSLKLSDNNCYLNAVIMTLDLLKDIKFVIPALQHAFMKHKGGDSTDFIALIMAYGNCTFGAPDDASRLLHTVLAKAELCCSARMVWREWCNVCGIKDVVLQGLKACCYVGVQTVEDLRARMTYVCQCGGERHRQLVEHTTPWLLLSGTPNEKLVTTSTAPDFVAFNVFQGIETAVGHYVHARLKGGLILKFDSGTVSKTSDWKCKVTDVLFPGQKYSSDCNVVRYSLDGNFRTEVDPDLSAFYVKDGKYFTSEPPVTYSPATILAGSVYTNSCLVSSDGQPGGDAISLSFNNLLGFDSSKPVTKKYTYSFLPKEDGDVLLAEFDTYDPIYKNGAMYKGKPILWVNKASYDTNLNKFNRASLRQIFDVAPIELENKFTPLSVESTPVEPPTVDVVALQQEMTIVKCKGLNKPFVKDNVSFVADDSGTPVVEYLSKEDLHTLYVDPKYQVIVLKDNVLSSMLRLHTVESGDINVVAASGSLTRKVKLLFRASFYFKEFATRTFTATTAVGSCIKSVVRHLGVTKGILTGCFSFAKMLFMLPLAYFSDSKLGTTEVKVSALKTAGVVTGNVVKQCCTAAVDLSMDKLRRVDWKSTLRLLLMLCTTMVLLSSVYHLYVFNQVLSSDVMFEDAQGLKKFYKEVRAYLGISSACDGLASAYRANSFDVPTFCANRSAMCNWCLISQDSITHYPALKMVQTHLSHYVLNIDWLWFAFETGLAYMLYTSAFNWLLLAGTLHYFFAQTSIFVDWRSYNYAVSSAFWLFTHIPMAGLVRMYNLLACLWLLRKFYQHVINGCKDTACLLCYKRNRLTRVEASTVVCGGKRTFYITANGGISFCRRHNWNCVDCDTAGVGNTFICEEVANDLTTALRRPINATDRSHYYVDSVTVKETVVQFNYRRDGQPFYERFPLCAFTNLDKLKFKEVCKTTTGIPEYNFIIYDSSDRGQESLARSACVYYSQVLCKSILLVDSSLVTSVGDSSEIATKMFDSFVNSFVSLYNVTRDKLEKLISTARDGVRRGDNFHSVLTTFIDAARGPAGVESDVETNEIVDSVQYAHKHDIQITNESYNNYVPSYVKPDSVSTSDLGSLIDCNAASVNQIVLRNSNGACIWNAAAYMKLSDALKRQIRIACRKCNLAFRLTTSKLRANDNILSVRFTANKIVGGAPTWFNALRDFTLKGYVLATIIVFLCAVLMYLCLPTFSMAPVEFYEDRILDFKVLDNGIIRDVNPDDKCFANKHRSFTQWYHEHVGGVYDNSITCPLTVAVIAGVAGARIPDVPTTLAWVNNQIIFFVSRVFANTGSVCYTPIDEIPYKSFSDSGCILPSECTMFRDAEGRMTPYCHDPTVLPGAFAYSQMRPHVRYDLYDGNMFIKFPEVVFESTLRITRTLSTQYCRFGSCEYAQEGVCITTNGSWAIFNDHHLNRPGVYCGSDFIDIVRRLAVSLFQPITYFQLTTSLVLGIGLCAFLTLLFYYINKVKRAFADYTQCAVIAVVAAVLNSLCICFVTSIPLCIVPYTALYYYATFYFTNEPAFIMHVSWYIMFGPIVPIWMTCVYTVAMCFRHFFWVLAYFSKKHVEVFTDGKLNCSFQDAASNIFVINKDTYAALRNSLTNDAYSRFLGLFNKYKYFSGAMETAAYREAAACHLAKALQTYSETGSDLLYQPPNCSITSGVLQSGLVKMSHPSGDVEACMVQVTCGSMTLNGLWLDNTVWCPRHVMCPADQLSDPNYDALLISMTNHSFSVQKHIGAPANLRVVGHAMQGTLLKLTVDVANPSTPAYTFTTVKPGAAFSVLACYNGRPTGTFTVVMRPNYTIKGSFLCGSCGSVGYTKEGSVINFCYMHQMELANGTHTGSAFDGTMYGAFMDKQVHQVQLTDKYCSVNVVAWLYAAILNGCAWFVKPNRTSVVSFNEWALANQFTEFVGTQSVDMLAVKTGVAIEQLLYAIQQLYTGFQGKQILGSTMLEDEFTPEDVNMQIMGVVMQSGVRKVTYGTAHWLFATLVSTYVIILQATKFTLWNYLFETIPTQLFPLLFVTMAFVMLLVKHKHTFLTLFLLPVAICLTYANIVYEPTTPISSALIAVANWLAPTNAYMRTTHTDIGVYISMSLVLVIVVKRLYNPSLSNFALALCSGVMWLYTYSIGEASSPIAYLVFVTTLTSDYTITVFVTVNLAKVCTYAIFAYSPQLTLVFPEVKMILLLYTCLGFMCTCYFGVFSLLNLKLRAPMGVYDFKVSTQEFRFMTANNLTAPRNSWEAMALNFKLIGIGGTPCIKVAAMQSKLTDLKCTSVVLLSVLQQLHLEANSRAWAFCVKCHNDILAATDPSEAFEKFVSLFATLMTFSGNVDLDALASDIFDTPSVLQATLSEFSHLATFAELEAAQKAYQEAMDSGDTSPQVLKALQKAVNIAKNAYEKDKAVARKLERMADQAMTSMYKQARAEDKKAKIVSAMQTMLFGMIKKLDNDVLNGIISNARNGCIPLSVIPLCASNKLRVVIPDFTVWNQVVTYPSLNYAGALWDITVINNVDNEIVKSSDVVDSNENLTWPLVLECTRASTSAVKLQNNEIKPSGLKTMVVSAGQEQTNCNTSSLAYYEPVQGRKMLMALLSDNAYLKWARVEGKDGFVSVELQPPCKFLIAGPKGPEIRYLYFVKNLNNLHRGQVLGHIAATVRLQAGSNTEFASNSSVLSLVNFTVDPQKAYLDFVNAGGAPLTNCVKMLTPKTGTGIAISVKPESTADQETYGGASVCLYCRAHIEHPDVSGVCKYKGKFVQIPAQCVRDPVGFCLSNTPCNVCQYWIGYGCNCDSLRQAALPQSKDSNFLNRVRGSIVNARIEPCSSGLSTDVVFRAFDICNYKAKVAGIGKYYKTNTCRFVELDDQGHHLDSYFVVKRHTMENYELEKHCYDLLRDCDAVAPHDFFIFDVDKVKTPHIVRQRLTEYTMMDLVYALRHFDQNSEVLKAILVKYGCCDVTYFENKLWFDFVENPSVIGVYHKLGERVRQAILNTVKFCDHMVKAGLVGVLTLDNQDLNGKWYDFGDFVITQPGSGVAIVDSYYSYLMPVLSMTDCLAAETHRDCDFNKPLIEWPLTEYDFTDYKVQLFEKYFKYWDQTYHANCVNCTDDRCVLHCANFNVLFAMTMPKTCFGPIVRKIFVDGVPFVVSCGYHYKELGLVMNMDVSLHRHRLSLKELMMYAADPAMHIASSNAFLDLRTSCFSVAALTTGLTFQTVRPGNFNQDFYDFVVSKGFFKEGSSVTLKHFFFAQDGNAAITDYNYYSYNLPTMCDIKQMLFCMEVVNKYFEIYDGGCLNASEVVVNNLDKSAGHPFNKFGKARVYYESMSYQEQDELFAMTKRNVIPTMTQMNLKYAISAKNRARTVAGVSILSTMTNRQYHQKMLKSMAATRGATCVIGTTKFYGGWDFMLKTLYKDVDNPHLMGWDYPKCDRAMPNMCRIFASLILARKHGTCCTTRDRFYRLANECAQVLSEYVLCGGGYYVKPGGTSSGDATTAYANSVFNILQATTANVSALMGANGNKIVDKEVKDMQFDLYVNVYRSTSPDPKFVDKYYAFLNKHFSMMILSDDGVVCYNSDYAAKGYIAGIQNFKETLYYQNNVFMSEAKCWVETDLKKGPHEFCSQHTLYIKDGDDGYFLPYPDPSRILSAGCFVDDIVKTDGTLMVERFVSLAIDAYPLTKHEDIEYQNVFWVYLQYIEKLYKDLTGHMLDSYSVMLCGDNSAKFWEEAFYRDLYSSPTTLQAVGSCVVCHSQTSLRCGTCIRRPFLCCKCCYDHVIATPHKMVLSVSPYVCNAPGCGVSDVTKLYLGGMSYFCVDHRPVCSFPLCANGLVFGLYKNMCTGSPSIVEFNRLATCDWTESGDYTLANTTTEPLKLFAAETLRATEEASKQSYAIATIKEIVGERQLLLVWEAGKSKPPLNRNYVFTGYHITKNSKVQLGEYIFERIDYSDAVSYKSSTTYKLTVGDIFVLTSHSVATLTAPTIVNQERYVKITGLYPTITVPEEFASHVANFQKSGYSKYVTVQGPPGTGKSHFAIGLAIYYPTARVVYTACSHAAVDALCEKAFKYLNIAKCSRIIPAKARVECYDRFKVNETNSQYLFSTINALPETSADILVVDEVSMCTNYDLSIINARIKAKHIVYVGDPAQLPAPRTLLTRGTLEPENFNSVTRLMCNLGPDIFLSMCYRCPKEIVSTVSALVYNNKLLAKKELSGQCFKILYKGNVTHDASSAINRPQLTFVKNFITANPAWSKAVFISPYNSQNAVSRSMLGLTTQTVDSSQGSEYQYVIFCQTADTAHANNINRFNVAITRAQKGILCVMTSQALFESLEFTELSFTNYKLQSQIVTGLFKDCSRETSGLSPAYAPTYVSVDDKYKTSDELCVNLNLPANVPYSRVISRMGFKLDATVPGYPKLFITREEAVRQVRSWIGFDVEGAHASRNACGTNVPLQLGFSTGVNFVVQPVGVVDTEWGNMLTGIAARPPPGEQFKHLVPLMHKGAAWPIVRRRIVQMLSDTLDKLSDYCTFVCWAHGFELTSASYFCKIGKEQKCCMCNRRAAAYSSPLQSYACWTHSCGYDYVYNPFFVDVQQWGYVGNLATNHDRYCSVHQGAHVASNDAIMTRCLAIHSCFIERVDWDIEYPYISHEKKLNSCCRIVERNVVRAALLAGSFDKVYDIGNPKGIPIVDDPVVDWHYFDAQPLTRKVQQLFYTEDMASRFADGLCLFWNCNVPKYPNNAIVCRFDTRVHSEFNLPGCDGGSLYVNKHAFHTPAYDVSAFRDLKPLPFFYYSTTPCEVHGNGSMIEDIDYVPLKSAVCITACNLGGAVCRKHATEYREYMEAYNLVSASGFRLWCYKTFDIYNLWSTFTKVQGLENIAFNVVKQGHFIGVEGELPVAVVNDKIFTKSGVNDICMFENKTTLPTNIAFELYAKRAVRSHPDFKLLHNLQADICYKFVLWDYERSNIYGTATIGVCKYTDIDVNSALNICFDIRDNCSLEKFMSTPNAIFISDRKIKKYPCMVGPDYAYFNGAIIRDSDVVKQPVKFYLYKKVNNEFIDPTECIYTQSRSCSDFLPLSDMEKDFLSFDSDVFIKKYGLENYAFEHVVYGDFSHTTLGGLHLLIGLYKKQQEGHIIMEEMLKGSSTIHNYFITETNTAAFKAVCSVIDLKLDDFVMILKSQDLGVVSKVVKVPIDLTMIEFMLWCKDGQVQTFYPRLQASADWKPGHAMPSLFKVQNVNLERCELANYKQSIPMPRGVHMNIAKYMQLCQYLNTCTLAVPANMRVIHFGAGSDKGIAPGTSVLRQWLPTDAIIIDNDLNEFVSDADITLFGDCVTVRVGQQVDLVISDMYDPTTKNVTGSNESKALFFTYLCNLINNNLALGGSVAIKITEHSWSVELYELMGKFAWWTVFCTNANASSSEGFLLGINYLGTIKENIDGGAMHANYIFWRNSTPMNLSTYSLFDLSKFQLKLKGTPVLQLKESQINELVISLLSQGKLLIRDNDTLSVSTDVLVNTYRKLR

SEQ ID NO: 14 - DNA, 30124 bp, human coronavirus
atttaagtgaatagcttggctatctcacttcccctcgttctcttgcagaactttgattttaacgaacttaaataaaagccctgttgtttagcgtatcgttgcacttgtctggtgggattgtggcattaatttgcctgctcatctaggcagtggacatatgctcaacactgggtataattctaattgaatactatttttcagttagagcgtcgtgtctcttgtacgtctcggtcacaatacacggtttcgtccggtgcgtggcaattcggggcacatcatgtctttcgtggctggtgtgaccgcgcaaggtgcgcgcggtacgtatcgagcagcgctcaactctgaaaaacatcaagaccatgtgtctctaactgtgccactctgtggttcaggaaacctggttgaaaaactttcaccatggttcatggatggcgaaaatgcctatgaagtggtgaaggccatgttacttaaaaaggagccacttctctatgtgcccatccggctggctggacacactagacacctcccaggtcctcgtgtgtacctggttgagaggctcattgcttgtgaaaatccattcatggttaaccaattggcttatagctctagtgcaaatggcagcctggttggcacaactttgcagggcaagcctattggtatgttcttcccttatgacatcgaacttgtcacaggaaagcaaaatattctcctgcgcaagtatggccgtggtggttatcactacaccccattccactatgagcgagacaacacctcttgccctgagtggatggacgattttgaggcggatcctaaaggcaaatatgcccagaatctgcttaagaagttgattggcggtgatgtcactccagttgaccaatacatgtgtggcgttgatggaaaacccattagtgcctacgcatttttaatggccaaggatggaataaccaaactggctgatgttgaagcggacgtcgcagcacgtgctgatgacgaaggcttcatcacattaaagaacaatctatatagattggtttggcatgttgagcgtaaagacgttccatatcctaagcaatctatttttactattaatagtgtggtccaaaaggatggtgttgaaaacactcctcctcactattttactcttggatgcaaaattttaacgctcaccccacgcaacaagtggagtggcgtttctgacttgtccctcaaacaaaaactcctttacaccttctatggtaaggagtcacttgagaacccaacctacatttaccactccgcattcattgagtgtggaagttgtggtaatgattcctggcttacagggaatgctatccaagggtttgcctgtggatgtggggcatcatatacagctaatgatgtcgaagtccaatcatctggcatgattaagccaaatgctcttctttgtgctacttgcccctttgctaagggtgatagctgttcttctaattgcaaacattcagttgctcagttggttagttacctttctgaacgctgtaatgttattgctgattctaagtccttcacacttatctttggtggcgtagcttacgcctactttggatgtgaggaaggtactatgtactttgtgcctagagctaagtctgttgtctcaaggattggagactccatctttacaggctgtactggctcttggaacaaggtcactcaaattgctaacatgttcttggaacagactcagcattcccttaactttgtgggagagttcgttgtcaacgatgttgtcctcgcaattctctctggaaccacaactaatgttgacaaaatacgccagcttctcaaaggtgtcacccttgacaagttgcgtgattatttagctgactatgacgtagcagtcactgccggcccattcatggataatgctattaatgttggtggtacaggattacagtatgccgccattactgcaccttatgtagttctcactggcttaggtgagtcctttaagaaagttgcaaccataccgtataaggtttgcaactctgttaaggatactctggcttattatgctcacagcgtgttgtacagagtttttccttatgacatggattctggtgtgtcatcctttagtgaactactttttgattgcgttgatctttcagtagcttctacctattttttagtccgcatcttgcaagataagactggcgactttatgtctacaattattacttcctgccaaactgctgttagtaagcttctagatacatgttttgaagctacagaagcaacatttaacttcttgttagatttggcaggattgttcagaatctttctccgcaatgcctatgtgtacacttcacaagggtttgtggtggtcaatggcaaagtttctacacttgtcaaacaagtgttagacttgcttaataagggtatgcaacttttgcatacaaaggtctcctgggctggttctaaaatcattgctgttatctacagcggcagggagtctctaatattcccatcgggaacctattactgtgtcaccactaaggctaagtccgttcaacaagatcttgacgttattttgcctggtgagttttccaagaagcagttaggactgctccaacctactgacaattctacaactgttagtgttactgtatccagtaacatggttgaaactgttgtgggtcaacttgagcaaactaatatgcatagtcctgatgttatagtaggtgactatgtcattattagtgaaaaattgtttgtgcgtagtaaggaagaagacggatttgccttctaccctgcttgcactaatggtcatgctgtaccgactctctttagacttaagggaggtgcacctagtaaaaaagtagcctttggcggtgatcaagtacatgaggttgctgctgtaagaagtgttactgtcgagtacaacattcatgctgtattagacacactacttgcttcttctagtcttagaacctttgttgtagataagtctttgtcaattgaggagtttgctgacgtagtaaaggaacaagtctcagacttgcttgttaaattactgcgtggaatgccgattccagattttgatttagacgattttattgacgcaccatgctattgctttaacgctgagggtgatgcatcctggtcttctactatgatcttctctcttcaccccgtcgagtgtgacgaggagtgttctgaagtagaggcttcagatttagaagaaggtgaatcagagtgcatttctgagacttcaactgaacaagttgacgtttctcatgagacttctgacgacgagtgggctgctgcagttgatgaagcgttccctctcgatgaagcagaagatgttactgaatctgtgcaagaagaagcacaaccagtagaagtacctgttgaagatattgcgcaggttgtcatagctgacaccttacaggaaactcctgttgtgcctgatactgttgaagtcccaccgcaagtggtgaaacttccgtctgcacctcagactatccagcccgaggtaaaagaagttgcacctgtctatgaggctgataccgaacagacacagaatgttactgttaaacctaagaggttacgcaaaaagcgtaatgttgaccctttgtccaattttgaacataaggttattacagagtgcgttaccatagttttaggtgacgcaattcaagtagccaagtgctatggggagtctgtgttagttaatgctgctaacacacatcttaagcatggcggtggtatcgctggtgctattaatgcggcttcaaaaggggctgtccaaaaagagtcagatgagtatattctggctaaagggccgttacaagtaggagattcagttctcttgcaaggccattctctagctaagaatatcctgcatgtcgtaggcccagatgcccgcgctaaacaggatgtttctctccttagtaagtgctataaggctatgaatgcatatcctcttgtagtcactcctcttgtttcagcaggcatatttggtgtaaaaccagctgtgtcttttgattatcttattagggaggctaagactagagttttagtcgtcgttaattcccaagatgtctataagagtcttaccatagttgacattccacagagtttgactttttcatatgatgggttacgtggcgcaatacgtaaagctaaagattatggttttactgtttttgtgtgcacagacaactctgctaacactaaagttcttaggaacaagggtgttgattatactaagaagtttcttacagttgacggtgtgcaatattattgctacacgtctaaggacactttagatgatatcttacaacaggctaataagtctgttggtattatatctatgcctttgggatatgtgtctcatggtttagacttaatgcaagcagggagtgtcgtgcgtagagttaacgtgccctacgtgtgtctcctagctaataaagagcaagaagctattttgatgtctgaagacgttaagttaaacccttcagaagattttataaagcacgtccgcactaatggtggttacaattcttggcatttagtcgagggtgaactattggtgcaagacttacgcttaaataagctcctgcattggtctgatcaaaccatatgctacaaggatagtgtgttttatgttgtaaagaatagtacagcttttccatttgaaacactttcagcatgtcgtgcgtatttggattcacgcacgacacagcagttaacaatcgaagtcttagtgactgtcgatggtgtaaattttagaacagtcgttctaaataataagaacacttatagatcacagcttggatgcgttttctttaatggtgctgatatttctgacaccattcctgatgagaaacagaatggtcacagtttatatctagcagacaatttgactgctgatgaaacaaaggcgcttaaagagttatatggccccgttgatcctactttcttacacagattctattcacttaaggctgcagtccatgggtggaagatggttgtgtgtgataaggtacgttctctcaaattgagtgataataattgttatcttaatgcagttattatgacacttgatttattgaaggacattaaatttgttatacctgctctacagcatgcatttatgaaacataagggcggtgattcaactgacttcatagccctcattatggcttatggcaattgcacatttggtgctccagatgatgcctctcggttacttcataccgtgcttgcaaaggctgagttatgctgttctgcacgcatggtttggagagagtggtgcaatgtctgtggcataaaagatgttgttctacaaggcttaaaagcttgttgttacgtgggtgtgcaaactgttgaagatctgcgtgctcgcatgacatatgtatgccagtgtggtggtgaacgtcatcggcaattagtcgaacacaccaccccctggttgctgctctcaggcacaccaaatgaaaaattggtgacaacctccacggcgcctgattttgtagcatttaatgtctttcagggcattgaaacggctgttggccattatgttcatgctcgcctgaagggtggtcttattttaaagtttgactctggcaccgttagcaagacttcagactggaagtgcaaggtgacagatgtacttttccccggccaaaaatacagtagcgattgtaatgtcgtacggtattctttggacggtaatttcagaacagaggttgatcccgacctatctgctttctatgttaaggatggtaaatactttacaagtgaaccacccgtaacatattcaccagctacaattttagctggtagtgtctacactaatagctgccttgtatcgtctgatggacaacctggcggtgatgctattagtttgagttttaataaccttttagggtttgattctagtaaaccagtcactaagaaatacacttactccttcttgcctaaagaagacggcgatgtgttgttggctgagtttgacacttatgaccctatttataagaatggtgccatgtataaaggcaaaccaattctttgggtcaataaagcatcttatgatactaatcttaataagttcaatagagctagtttgcgtcaaatttttgacgtagcccccattgaactcgaaaataaattcacacctttgagtgtggagtctacaccagttgaacctccaactgtagatgtggtagcacttcaacaggaaatgacaattgtcaaatgtaagggtttaaataaacctttcgtgaaggacaatgtcagtttcgttgctgatgattcaggtactcccgttgttgagtatctgtctaaagaagacctacatacattgtatgtagaccctaagtatcaagtcattgtcttaaaagacaatgtactttcttctatgcttagattgcacaccgttgagtcaggtgatattaacgttgttgcagcttccggatctttgacacgtaaagtgaagttactatttagggcttcattttatttcaaagaatttgctacccgcactttcactgctaccactgctgtaggtagttgtataaagagtgtagtgcggcatctaggtgttactaaaggcatattgacaggctgttttagttttgccaagatgttatttatgcttccactagcttactttagtgattcaaaactcggcaccacagaggttaaagtgagtgctttgaaaacagccggcgttgtgacaggtaatgttgtaaaacagtgttgcactgctgctgttgatttaagtatggataagttgcgccgtgtggattggaaatcaaccctacggttgttacttatgttatgcacaactatggtattgttgtcttctgtgtatcacttgtatgtcttcaatcaggtcttatcaagtgatgttatgtttgaagatgcccaaggtttgaaaaagttctacaaagaagttagagcttacctaggaatctcttctgcttgtgacggtcttgcttcagcttatagggcgaattcctttgatgtacctacattctgcgcaaaccgttctgcaatgtgtaattggtgcttgattagccaagattccataactcactacccagctcttaagatggttcaaacacatcttagccactatgttcttaacatagattggttgtggtttgcatttgagactggtttggcatacatgctctatacctcggccttcaactggttgttgttggcaggtacattgcattatttctttgcacagacttccatatttgtagactggcggtcatacaattatgctgtgtctagtgccttctggttattcacccacattccaatggcgggtttggtacgaatgtataatttgttagcatgcctttggcttttacgcaagttttatcagcatgtaatcaatggttgcaaagatacggcatgcttgctctgctataagaggaaccgacttactagagttgaagcttctaccgttgtctgtggtggaaaacgtacgttttatatcacagcaaatggcggtatttcattctgtcgtaggcataattggaattgtgtggattgtgacactgcaggtgtggggaataccttcatctgtgaagaagtcgcaaatgacctcactaccgccctacgcaggcctattaacgctacggatagatcacattattatgtggattccgttacagttaaagagactgttgttcagtttaattatcgtagagacggtcaaccattctacgagcggtttcccctctgcgcttttacaaatctagataagttgaagttcaaagaggtctgtaaaactactactggtatacctgaatacaactttatcatctacgactcatcagatcgtggccaggaaagtttagctaggtctgcatgtgtttattattctcaagtcttgtgtaaatcaattcttttggttgactcaagtttggttacttctgttggtgattctagtgaaatcgccactaaaatgtttgattcctttgttaatagtttcgtctcgctgtataatgtcacacgcgataagttggaaaaacttatctctactgctcgtgatggcgtaaggcgaggcgataacttccatagtgtcttaacaacattcattgacgcagcacgaggccccgcaggtgtggagtctgatgttgagaccaatgaaattgttgactctgtgcagtatgctcataaacatgacatacaaattactaatgagagctacaataattatgtaccctcatatgttaaacctgatagtgtgtctaccagcgatttaggtagtctcattgattgtaatgcggcttcagttaaccaaattgtcttgcgtaattctaatggtgcttgcatttggaacgctgctgcatatatgaaactctcggatgcacttaaacgacagattcgcattgcatgccgtaagtgtaatttagctttccggttaaccacctcaaagctacgcgctaatgataatatcttatcagttagattcactgctaacaaaattgttggtggtgctcctacatggtttaatgcgttgcgtgactttacgttaaagggttatgttcttgctaccattattgtgtttctgtgtgctgtactgatgtatttgtgtttacctacattttctatggcacctgttgaattttatgaagaccgcatcttggactttaaagttcttgataatggtatcattagggatgtaaatcctgatgataagtgctttgctaataagcaccggtccttcacacaatggtatcatgagcatgttggtggtgtctatgacaactctatcacatgcccattgacagttgcagtaattgctggagttgctggtgctcgcattccagacgtacctactacattggcttgggtgaacaatcagataattttctttgtttctcgagtctttgctaatacaggcagtgtttgctacactcctatagatgagataccctataagagtttctctgatagtggttgcattcttccatctgagtgcactatgtttagggatgcagagggccgtatgacaccatactgccatgatcctactgttttgcctggggcttttgcgtacagtcagatgaggcctcatgttcgttacgacttgtatgatggtaacatgtttattaaatttcctgaagtagtatttgaaagtacacttaggattactagaactctgtcaactcagtactgccggttcggtagttgtgagtatgcacaagagggtgtttgtattaccacaaatggctcgtgggccatttttaatgaccaccatcttaatagacctggtgtctattgtggctctgattttattgacattgtcaggcggttagcagtatcactgttccagcctattacttatttccaattgactacctcattggtcttgggtataggtttgtgtgcgttcctgactttgctcttctattatattaataaagtaaaacgtgcttttgcagattacacccagtgtgctgtaattgctgttgttgctgctgttcttaatagcttgtgcatctgctttgttacctctataccattgtgtatagtaccttacactgcattgtactattatgctacattctattttactaatgagcctgcatttattatgcatgtttcttggtacattatgttcgggcctatcgttcccatatggatgacctgcgtctatacagttgcaatgtgctttagacacttcttctgggttttagcttattttagtaagaaacatgtagaagtttttactgatggtaagcttaattgtagtttccaggacgctgcctctaatatctttgttattaacaaggacacttatgcagctcttagaaactctttaactaatgatgcctattcacgatttttggggttgtttaacaagtataagtacttctctggtgctatggaaacagccgcttatcgtgaagctgcagcatgtcatcttgctaaagccttacaaacatacagcgagactggtagtgatcttctttaccaaccacccaactgtagcataacctctggcgtgttgcaaagcggtttggtgaaaatgtcacatcccagtggagatgttgaggcttgtatggttcaggttacctgcggtagcatgactcttaatggtctttggcttgacaacacagtctggtgcccacgacacgtaatgtgcccggctgaccagttgtctgatcctaattatgatgccttgttgatttctatgactaatcatagtttcagtgtgcaaaaacacattggcgctccagcaaacttgcgtgttgttggtcatgccatgcaaggcactcttttgaagttgactgtcgatgttgctaaccctagcactccagcctacacttttacaacagtgaaacctggcgcagcatttagtgtgttagcatgctataatggtcgtccgactggtacattcactgttgtaatgcgccctaactacacaattaagggttcctttctgtgtggttcttgtggtagtgttggttacaccaaggagggtagtgtgatcaatttctgttacatgcatcaaatggaacttgctaatggtacacataccggttcagcatttgatggtactatgtatggtgcctttatggataaacaagtgcaccaagttcagttaacagacaaatactgcagtgttaatgtagtagcttggctttacgcagcaatacttaatggttgcgcttggtttgtaaaacctaatcgcactagtgttgtttcttttaatgaatgggctcttgccaaccaattcactgaatttgttggcactcaatccgttgacatgttagctgtcaaaacaggcgttgctattgaacagctgctttatgcgatccaacaactgtatactgggttccagggaaagcaaatccttggcagtaccatgttggaagatgaattcacacctgaggatgttaatatgcagattatgggtgtggttatgcagagtggtgtgagaaaagttacatatggtactgcgcattggttgtttgcgacccttgtctcaacctatgtgataatcttacaagccactaaatttactttgtggaactacttgtttgagactattcccacacagttgttcccactcttatttgtgactatggccttcgttatgttgttggttaaacacaaacacacctttttgacacttttcttgttgcctgtggctatttgtttgacttatgcaaacatagtctacgagcccactactcccatttcgtcagcgctgattgcagttgcaaattggcttgcccccactaatgcttatatgcgcactacacatactgatattggtgtctacattagtatgtcacttgtattagtcattgtagtgaagagattgtacaacccatcactttctaactttgcgttagcattgtgcagtggtgtaatgtggttgtacacttatagcattggagaagcctcaagccccattgcctatctggtttttgtcactacactcactagtgattatacgattacagtctttgttactgtcaaccttgcaaaagtttgcacttatgccatctttgcttactcaccacagcttacacttgtgtttccggaagtgaagatgatacttttattatacacatgtttaggtttcatgtgtacttgctattttggtgtcttctctcttttgaaccttaagcttagagcacctatgggtgtctatgactttaaggtctcaacacaagagttcagattcatgactgctaacaatctaactgcacctagaaattcttgggaggctatggctctgaactttaagttaataggtattggcggtacaccttgtataaaggttgctgctatgcagtctaaacttacagatcttaaatgcacatctgtggttctcctctctgtgctccaacagttacacttagaggctaatagtagggcctgggctttctgtgttaaatgccataatgatatattggcagcaacagaccccagtgaggctttcgagaaattcgtaagtctctttgctactttaatgactttttctggtaatgtagatcttgatgcgttagctagtgatatttttgacactcctagcgtacttcaagctactctttctgagttttcacacttagctacctttgctgagttggaagctgcgcagaaagcctatcaggaagctatggactctggtgacacctcaccacaagttcttaaggctttgcagaaggctgttaatatagctaaaaacgcctatgagaaggataaggcagtggcccgtaagttagaacgtatggctgatcaggctatgacttctatgtataagcaagcacgtgctgaagacaagaaagcaaaaattgtcagtgctatgcaaactatgttgtttggtatgattaagaagctcgacaacgatgttcttaatggtatcatttctaacgctaggaatggttgtatacctcttagtgtcatcccactgtgtgcttcaaataaacttcgcgttgtaattcctgacttcaccgtctggaatcaggtagtcacatatccctcgcttaactacgctggggctttgtgggacattacagttataaacaatgtggacaatgaaattgttaagtcttcagatgttgtagacagcaatgaaaatttaacatggccacttgttttagaatgcactagggcatccacttctgccgttaagttgcaaaataatgagatcaaaccttcaggtctaaaaaccatggttgtgtctgcgggtcaagagcaaactaactgtaatactagttccttagcttattacgaacctgtgcagggtcgtaaaatgctgatggctcttctttctgataatgcctatctcaaatgggcgcgtgttgaaggtaaggacggatttgtcagtgtagagctacaacctccttgcaaattcttgattgcgggaccaaaaggacctgaaatccgatatctctattttgttaaaaatcttaacaaccttcatcgcgggcaagtgttagggcacattgctgcgactgttagattgcaagctggttctaacaccgagtttgcctctaattcctcggtgttgtcacttgttaacttcaccgttgatcctcaaaaagcttatctcgatttcgtcaatgcgggaggtgccccattgacaaattgtgttaagatgcttactcctaaaactggtacaggtatagctatatctgttaaaccagagagtacagctgatcaagagacttatggtggagcttcagtgtgtctctattgccgtgcgcatatagaacatcctgatgtctctggtgtttgtaaatataagggtaagtttgtccaaatccctgctcagtgtgtccgtgaccctgtgggattttgtttgtcaaataccccctgtaatgtctgtcaatattggattggatatgggtgcaattgtgactcgcttaggcaagcagcactgccccaatctaaagattccaattttttaaacgagtccggggttctattgtaaatgcccgaatagaaccctgttcaagtggtttgtccactgatgtcgtctttagggcatttgacatctgcaactataaggctaaggttgctggtattggaaaatactacaagactaatacttgtaggtttgtagaattagatgaccaagggcatcatttagactcctattttgtcgttaagaggcatactatggagaattatgaactagagaagcactgttacgacttgttacgtgactgtgatgctgtagctccccatgatttcttcatctttgatgtagacaaagttaaaacacctcatattgtacgtcagcgtttaactgagtacactatgatggatcttgtatatgccctgaggcactttgatcaaaatagcgaagtgcttaaggctatcttagtgaagtatggttgctgtgatgttacctactttgaaaataaactctggtttgattttgttgaaaatcccagtgttattggtgtttatcataaacttggagaacgtgtacgccaagctatcttaaacactgttaaattttgtgaccacatggtcaaggctggtttagtcggtgtgctcacactagacaaccaggaccttaatggcaagtggtatgattttggtgacttcgtaatcactcaacctggttcaggagtagctatagttgatagctactattcttatttgatgcctgtgctctcaatgaccgattgtctggccgctgagacacatagggattgtgattttaataaaccactcattgagtggccacttactgagtatgattttactgattataaggtacaactctttgagaagtactttaaatattgggatcagacgtatcacgcaaattgcgttaattgtactgatgaccgttgtgtgttacattgtgctaatttcaatgtattgtttgctatgaccatgcctaagacttgtttcggacccatagtccgaaagatctttgttgatggcgtgccatttgtagtatcttgtggttatcactacaaagaattaggtttagtcatgaatatggatgttagtctccatagacataggctctctcttaaggagttgatgatgtatgccgctgatccagccatgcacattgcctcctctaacgcttttcttgatttgaggacatcatgttttagtgtcgctgcacttacaactggtttgacttttcaaactgtgcggcctggcaattttaaccaagacttctatgatttcgtggtatctaaaggtttctttaaggagggctcttcagtgacgctcaaacattttttctttgctcaagatggtaatgctgctattacagattataattactattcttataatctgcctactatgtgtgacatcaaacaaatgttgttctgcatggaagttgtaaacaagtacttcgaaatctatgacggtggttgtcttaatgcttctgaagtggttgttaataatttagacaagagtgctggccatccttttaataagtttggcaaagctcgtgtctattatgagagcatgtcttaccaggagcaagatgaactttttgccatgacaaagcgtaacgtcattcctaccatgactcaaatgaatctaaaatatgctattagtgctaagaatagagctcgcactgttgcaggcgtgtccatacttagcacaatgactaatcgccagtaccatcagaaaatgcttaagtccatggctgcaactcgtggagcgacttgcgtcattggtactacaaagttctacggtggctgggatttcatgcttaaaacattgtacaaagatgttgataatccgcatcttatgggttgggattaccctaagtgtgatagagctatgcctaatatgtgtagaatcttcgcttcactcatattagctcgtaaacatggcacttgttgtactacaagggacagattttatcgcttggcaaatgagtgtgctcaggtgctaagcgaatatgttctatgtggtggtggttactacgtcaaacctggaggtaccagtagcggagatgccaccactgcatatgccaatagtgtctttaacattttgcaggcgacaactgctaatgtcagtgcacttatgggtgctaatggcaacaagattgttgacaaagaagttaaagacatgcagtttgatttgtatgtcaatgtttacaggagcactagcccagaccccaaatttgttgataaatactatgcttttcttaataagcacttttctatgatgatactgtctgatgacggtgtcgtttgctataatagtgattatgcagctaagggttacattgctggaatacagaattttaaggaaacgctgtattatcagaacaatgtctttatgtctgaagctaaatgctgggtggaaaccgatctgaagaaagggccacatgaattctgttcacagcatacgctttatattaaggatggcgacgatggttacttccttccttatccagacccttcaagaattttgtctgccggttgctttgtagatgatatcgttaagactgacggtacactcatggtagagcggtttgtgtctttggctatagatgcttaccctctcacaaagcatgaagatatagaataccagaatgtattctgggtctacttacagtatatagaaaaactgtataaagaccttacaggacacatgcttgacagttattctgtcatgctatgtggtgataattctgctaagttttgggaagaggcattctatagagatctctatagttcgcctaccactttgcaggctgtcggttcatgcgttgtatgccattcacagacttccctacgctgtgggacatgcatccgtagaccatttctctgctgtaaatgctgctatgatcatgttatagcaactccacataagatggttttgtctgtttctccttacgtttgtaatgcccctggttgtggcgtttcagacgttactaagctatatttaggtggtatgagctacttttgtgtagatcatagacctgtgtgtagttttccactttgcgctaatggtcttgtattcggcttatacaagaatatgtgcacaggtagtccttctatagttgaatttaataggttggctacctgtgactggactgaaagtggtgattacacccttgccaatactacaacagaaccactcaaactttttgctgctgagactttacgtgccactgaagaggcgtctaagcagtcttatgctattgccaccatcaaagaaattgttggtgagcgccaactattacttgtgtgggaggctggcaagtccaaaccaccactcaatcgtaattatgtttttactggttatcatataaccaaaaatagtaaagtgcagctcggtgagtacattttcgagcgcattgattatagtgatgctgtatcctacaagtctagtacaacgtataaactgactgtaggtgacatcttcgtacttacctctcactctgtggctaccttgacggcgcccacaattgtgaatcaagagaggtatgttaaaattactgggttgtacccaaccattacggtacctgaagagttcgcaagtcatgttgccaacttccaaaaatcaggttatagtaaatatgtcactgttcagggaccacctggcactggcaaaagtcattttgctatagggttagcgatttactaccctacagcacgtgttgtttatacagcatgttcacacgcagctgttgatgctttgtgtgaaaaagcttttaaatatttgaacattgctaaatgttcccgtatcattcctgcaaaggcacgtgttgagtgctatgacaggtttaaagttaatgagacaaattctcaatatttgtttagtactattaatgctctaccagaaacttctgccgatattctggtggttgatgaggttagtatgtgcactaattatgatctttcaattattaatgcacgtattaaagctaagcacattgtctatgtaggagatccagcacagttgccagctcctaggactttgttgactagaggcacattggaaccagaaaatttcaatagtgtcactagattgatgtgtaacttaggtcctgacatatttttaagtatgtgctacaggtgtcctaaggaaatagtaagcactgtgagcgctcttgtctacaataataaattgttagccaagaaggagctttcaggccagtgctttaaaatactctataagggcaatgtgacgcatgatgctagctctgccattaatagaccacaactcacatttgtgaagaattttattactgccaatccggcatggagtaaggcagtctttatttcgccttacaattcacagaatgctgtgtctcgttcaatgctgggtcttaccactcagactgttgattcctcacagggttcagaataccagtacgttatcttctgtcaaacagcagatacggcacatgctaacaacattaacagatttaatgttgcaatcactcgtgcccaaaaaggtattctttgtgttatgacatctcaggcactctttgagtccttagagtttactgaattgtcttttactaattacaagctccagtctcagattgtaactggcctttttaaagattgctctagagaaacttctggcctctcacctgcttatgcaccaacatatgttagtgttgatgacaagtataagacgagtgatgagctttgcgtgaatcttaatttacccgcaaatgtcccatactctcgtgttatttccaggatgggctttaaactcgatgcaacagttcctggatatcctaagcttttcattactcgtgaagaggctgtaaggcaagttcgaagctggataggcttcgatgttgagggtgctcatgcttcccgtaatgcatgtggcaccaatgtgcctctacaattaggattttcaactggtgtgaactttgttgttcagccagttggtgttgtagacactgagtggggtaacatgttaacgggcattgctgcacgtcctccaccaggtgaacagtttaagcacctcgtgcctcttatgcataagggggctgcgtggcctattgttagacgacgtatagtgcaaatgttgtcagacactttagacaaattgtctgattactgtacgtttgtttgttgggctcatggctttgaattaacgtctgcatcatacttttgcaagataggtaaggaacagaagtgttgcatgtgcaatagacgcgctgcagcgtactcttcacctctgcaatcttatgcctgctggactcattcctgcggttatgattatgtctacaaccctttctttgtcgatgttcaacagtggggttatgtaggcaatcttgctactaatcacgatcgttattgctctgtccatcaaggagctcatgtggcttctaatgatgcaataatgactcgttgtttagctattcattcttgttttatagaacgtgtggattgggatatagagtatccttatatctcacatgaaaagaaattgaattcctgttgtagaatcgttgagcgcaacgtcgtacgtgctgctcttcttgccggttcatttgacaaagtctatgatattggcaatcctaaaggaattcctattgttgatgaccctgtggttgattggcattattttgatgcacagcccttgaccaggaaggtacaacagcttttctatacagaggacatggcctcaagatttgctgatgggctctgcttattttggaactgtaatgtaccaaaatatcctaataatgcaattgtatgcaggtttgacacacgtgtgcattctgagttcaatttgccaggttgtgatggcggtagtttgtatgttaacaagcacgcttttcatacaccagcatatgatgtgagtgcattccgtgatctgaaacctttaccattcttttattattctactacaccatgtgaagtgcatggtaatggtagtatgatagaggatattgattatgtacccctaaaatctgcagtctgtattacagcttgtaatttagggggcgctgtttgtaggaagcatgctacagagtacagagagtatatggaagcatataatcttgtctctgcatcaggtttccgcctttggtgttataagacctttgatatttataatctctggtctacttttacaaaagttcaaggtttggaaaacattgcttttaatgttgttaaacaaggccattttattggtgttgagggtgaactacctgtagctgtagtcaatgataagatcttcaccaagagtggcgttaatgacatttgtatgtttgagaataaaaccactttgcctactaatatagcttttgaactctatgctaagcgtgctgtacgctcgcatcccgatttcaaattgctacacaatttacaagcagacatttgctacaagttcgtcctttgggattatgaacgtagcaatatttatggtactgctactattggtgtatgtaagtacactgatattgatgttaattcagctttgaatatatgttttgacatacgcgataattgttcattggagaagttcatgtctactcccaatgccatctttatttctgatagaaaaatcaagaaatacccttgtatggtaggtcctgattatgcttacttcaatggtgctatcatccgtgatagtgatgttgttaaacaaccagtgaagttctacttgtataagaaagtcaataatgagtttattgatcctactgagtgtatttacactcagagtcgctcttgtagtgacttcctacccctttctgacatggagaaagactttctatcttttgatagtgatgttttcattaagaagtatggcttggaaaactatgcttttgagcacgtagtctatggagacttctctcatactacgttaggcggtcttcacttgcttattggtttatacaagaagcaacaggaaggtcatattattatggaagaaatgctaaaaggtagctcaactattcataactattttattactgagactaacacagcggcttttaaggcggtgtgttctgttatagatttaaagcttgacgactttgttatgattttaaagagtcaagaccttggcgtagtatccaaggttgtcaaggttcctattgacttaacaatgattgagtttatgttatggtgtaaggatggacaggttcaaaccttctaccctcgactccaggcttctgcagattggaaacctggtcatgcaatgccatccctctttaaagttcaaaatgtaaaccttgaacgttgtgagcttgctaattacaagcaatctattcctatgcctcgcggtgtgcacatgaacatcgctaaatatatgcaattgtgccagtatttaaatacttgcacattagccgtgcctgccaatatgcgtgttatacattttggcgctggttctgataaaggtatcgctcctggtacctcagttttacgacagtggcttcctacagatgccattattatagataatgatttaaatgagttcgtgtcagatgctgacataactttatttggagattgtgtaactgtacgtgtcggccaacaagtggatcttgttatttccgacatgtatgatcctactactaagaatgtaacaggtagtaatgagtcaaaggctttattctttacttacctgtgtaacctcattaataataatcttgctcttggtgggtctgttgctattaaaataacagaacactcttggagcgttgaactttatgaacttatgggaaaatttgcttggtggactgttttctgcaccaatgcaaatgcatcctcatctgaaggattcctcttaggtattaattacttgggtactattaaagaaaatatagatggtggtgctatgcacgccaactatatattttggagaaattccactcctatgaatctgagtacttactcactttttgatttatccaagtttcaattaaaattaaaaggaacaccagttcttcaattaaaggagagtcaaattaacgaactcgtaatatctctcctgtcgcagggtaagttacttatccgtgacaatgatacactcagtgtttctactgatgttcttgttaacacctacagaaagttacgttgatgtagggccagattctgttaagtctgcttgtattgaggttgatatacaacagactttctttgataaaacttggcctaggccaattgatgtttctaaggctgacggtattatataccctcaaggccgtacatattctaacataactatcacttatcaaggtctttttccctatcagggagaccatggtgatatgtatgtttactctgcaggacatgctacaggcacaactccacaaaagttgtttgtagctaactattctcaggacgtcaaacagtttgctaatgggtttgtcgtccgtataggagcagctgccaattccactggcactgttattattagcccatctaccagcgctactatacgaaaaatttaccctgcttttatgctgggttcttcagttggtaatttctcagatggtaaaatgggccgcttcttcaatcatactctagttcttttgcccgatggatgtggcactttacttagagctttttattgtattctagagcctcgctctggaaatcattgtcctgctggcaattcctatacttcttttgccacttatcacactcctgcaacagattgttctgatggcaattacaatcgtaatgccagtctgaactcttttaaggagtattttaatttacgtaactgcacctttatgtacacttataacattaccgaagatgagattttagagtggtttggcattacacaaactgctcaaggtgttcacctcttctcatctcggtatgttgatttgtacggcggcaatatgtttcaatttgccaccttgcctgtttatgatactattaagtattattctatcattcctcacagtattcgttctatccaaagtgatagaaaagcttgggctgccttctacgtatataaacttcaaccgttaactttcctgttggatttttctgttgatggttatatacgcagagctatagactgtggttttaatgatttgtcacaactccactgctcatatgaatccttcgatgttgaatctggagtttattcagtttcgtctttcgaagcaaaaccttctggctcagttgtggaacaggctgaaggtgttgaatgtgatttttcacctcttctgtctggcacacctcctcaggtttataatttcaagcgtttggtttttaccaattgcaattataatcttaccaaattgctttcacttttttctgtgaatgattttacttgtagtcaaatatctccagcagcaattgctagcaactgttattcttcactgattttggattacttttcatacccacttagtatgaaatccgatctcagtgttagttctgctggtccaatatcccagtttaattataaacagtccttttctaatcccacatgtttgattttagcgactgttcctcataaccttactactattactaagcctcttaagtacagctatattaacaagtgctctcgtcttctttctgatgatcgtactgaagtacctcagttagtgaacgctaatcaatactcaccctgtgtatccattgtcccatccactgtgtgggaagacggtgattattataggaaacaactatctccacttgaaggtggtggctggcttgttgctagtggctcaactgttgccatgactgagcaattacagatgggctttggtattacagttcaatatggtacagacaccaatagtgtttgccccaagcttgaatttgctaatgacacaaaaattgcctctcaattaggcaattgcgtggaatattccctctatggtgtttcgggccgtggtgtttttcagaattgcacagctgtaggtgttcgacagcagcgctttgtttatgatgcgtaccagaatttagttggctattattctgatgatggcaactactactgtttgcgtgcttgtgttagtgttcctgtttctgtcatctatgataaagaaactaaaacccacgctactctatttggtagtgttgcatgtgaacacatttcttctaccatgtctcaatactcccgttctacgcgatcaatgcttaaacggcgagattctacatatggcccccttcagacacctgttggttgtgtcctaggacttgttaattcctctttgttcgtagaggactgcaagttgcctcttggtcaatctctctgtgctcttcctgacacacctagtactctcacacctcgcagtgtgcgctctgttccaggtgaaatgcgcttggcatccattgcttttaatcatcctattcaggttgatcaacttaatagtagttattttaaattaagtatacccactaatttttcctttggtgtgactcaggagtacattcagacaaccattcagaaagttactgttgattgtaaacagtacgtttgcaatggtttccagaagtgtgagcaattactgcgcgagtatggccagttttgttccaaaataaaccaggctctccatggtgccaatttacgccaggatgattctgtacgtaatttgtttgcgagcgtgaaaagctctcaatcatctcctatcataccaggttttggaggtgactttaatttgacacttctagaacctgtttctatatctactggcagtcgtagtgcacgtagtgctattgaggatttgctatttgacaaagtcactatagctgatcctggttatatgcaaggttacgatgattgcatgcagcaaggtccagcatcagctcgtgatcttatttgtgctcaatatgtggctggttacaaagtattacctcctcttatggatgttaatatggaagccgcgtatacttcatctttgcttggcagcatagcaggtgttggctggactgctggcttatcctcctttgctgctattccatttgcacagagtatcttttataggttaaacggtgttggcattactcaacaggttctttcagagaaccaaaagcttattgccaataagtttaatcaggctctgggagctatgcaaacaggcttcactacaactaatgaagcttttcagaaggttcaggatgctgtgaacaacaatgcacaggctctatccaaattagctagcgagctatctaatacttttggtgctatttccgcctctattggagacatcatacaacgtcttgatgttctcgaacaggacgcccaaatagacagacttattaatggccgtttgacaacactaaatgcttttgttgcacagcagcttgttcgttccgaatcagctgctctttccgctcaattggctaaagataaagtcaatgagtgtgtcaaggcacaatccaagcgttctggattttgcggtcaaggcacacatatagtgtcctttgttgtaaatgcccctaatggcctttacttcatgcatgttggttattaccctagcaaccacattgaggttgtttctgcttatggtctttgcgatgcagctaaccctactaattgtatagcccctgttaatggctactttattaaaactaataacactaggattgttgatgagtggtcatatactggctcgtccttctatgcacctgagcccattacctcccttaatactaagtatgttgcaccacaggtgacataccaaaacatttctactaacctccctcctcctcttctcggcaattccaccgggattgacttccaagatgagttggatgagtttttcaaaaatgttagcaccagtatacctaattttggttccctaacacagattaatactacattactcgatcttacctacgagatgttgtctcttcaacaagttgttaaagcccttaatgagtcttacatagaccttaaagagcttggcaattatacttattacaacaaatggccgtggtacatttggcttggtttcattgctgggcttgttgccttagctctatgcgtcttcttcatactgtgctgcactggttgtggcacaaactgtatgggaaaacttaagtgtaatcgttgttgtgatagatacgaggaatacgacctcgagccgcataaggttcatgttcactaattaacgaactattaatgagagttcaaagaccacccactctcttgttagtgttttcactctctcttttggtcactgcatcctcaaaacctctctatgtacctgagcattgtcagaattattctggttgcatgcttagggcttgtattaaaactgcccaagctgatacagctggtctttatacaaattttcgaattgacgtcccatctgcagaatcaactggtactcaatcagtttctgtcgatcttgagtcaacttcaactcatgatggtcctaccgaacatgttactagtgtgaatctttttgacgttggttactcagttaattaacgaactctatggattacgtgtctctgcttaatcaaatttggcagaagtaccttaactcaccgtatactacttgtttgtacatccctaaacccacagctaagtatacacctttagttggcacttcattgcaccctgtgctgtggaactgtcagctatcctttgctggttatactgaatctgctgttaattctacaaaagctttggccaaacaggacgcagctcagcgaatcgcttggttgctacataaggatggaggaatccctgatggatgttccctctacctccggcactcaagtttattcgcgcaaagcgaggaagaggagccattctccaactaagaaactgcgctacgttaagcgtagattttctcttctgcgccatgaagaccttagtgttattgtccaaccaacacactatgtcagggttacattttcagaccccaacatgtggtatctacgttcgggtcatcatttacactcagttcacaattggcttaaaccttatggcggccaacctgtttctgagtaccatattactctagctttgctaaatctcactgatgaagatttagctagagatttttcacccattgcgctctttttgcgcaatgtcagatttgagctacatgagttcgccttgctgcgcaaaactcttgttcttaatgcatcagagatctactgtgctaacatacatagatttaagcctgtgtatagagttaacacggcaatccctactattaaggattggcttctcgttcagggattttccctttaccatagtggcctccctttacatatgtcaatctctaaattgcatgcactggatgatgttactcgcaattacatcattacaatgccatgctttagaacttaccctcaacaaatgtttgttactcctttggccgtagatgttgtctccatacggtcttccaatcagggtaataaacaaattgttcattcttatcccattttacatcatccaggattttaacgaactatggctttctcggcgtctttatttaaacccgtccagctagtcccagtttctcctgcatttcatcgcattgagtctactgactctattgttttcacatacattcctgctagcggctatgtagctgctttagctgtcaatgtgtgtctcattcccctattattactgctacgtcaagatacttgtcgtcgcagcattatcagaactatggttctctatttccttgttctgtataactttttattagccattgtactagtcaatggtgtacattatccaactggaagttgcctgatagccttcttagttatcctcataatactttagtttgtagatagaattcgtttctgtctcatgctgaattcctacattccactgtttgacatgcgttcccactttattcgtgttagtacagtttcttctcatggtatggtccctgtaatacacaccaaaccattatttattagaaacttcgatcagcgttgcagctgttctcgttgtttttatttgcactcttccacttatatagagtgcacttatattagccgttttagtaagattagcctagtttctgtaactgacttctccttaaacggcaatgtttccactgttttcgtgcctgcaacgcgcgattcagttcctcttcacataatcgccccgagctcgcttatcgtttaagcagctctgcgctactatgggtcccgtgtagaggctaatccattagtctctctttggacatatggaaaacgaactatgttaccctttgtccaagaacgaatagggttgttcatagtaaactttttcatttttaccgtagtatgtgctataacactcttggtgtgtatggctttccttacggctactagattatgtgtgcaatgtatgacaggcttcaataccctgttagttcagcccgcattatacttgtataatactggacgttcagtctatgtaaaattccaggatagtaaaccccctctaccacctgacgagtgggtttaacgaactccttcataatgtctaatatgacgcaactcactgaggcgcagattattgccattattaaagactggaactttgcatggtccctgatctttctcttaattactatcgtactacagtatggatacccatcccgtagtatgactgtctatgtctttaaaatgtttgttttatggctcctatggccatcttccatggcgctatcaatatttagcgccgtttatccaattgatctagcttcccagataatctctggcattgtagcagctgtttcagctatgatgtggatttcctactttgtgcagagtatccggctgtttatgagaactggatcatggtggtcattcaatcctgagactaattgccttttgaacgttccatttggtggtacaactgtcgtacgtccactcgtagaggactctaccagtgtaactgctgttgtaaccaatggccacctcaaaatggctggcatgcatttcggtgcttgtgactacgacagacttcctaatgaagtcaccgtggccaaacccaatgtgctgattgctttaaaaatggtgaagcggcaaagctacggaactaattccggcgttgccatttaccatagatataaggcaggtaattacaggagtccgcctattacggcggatattgaacttgcattgcttcgagcttaggctctttagtaagagtatcttaattgattttaacgaatctcaatttcattgttatggcatcccctgctgcacctcgtgctgtttcctttgccgataacaatgatataacaaatacaaacctatctcgaggtagaggacgtaatccaaaaccacgagctgcaccaaataacactgtctcttggtacactgggcttacccaacacgggaaagtccctcttacctttccacctgggcagggtgtacctcttaatgccaattctacccctgcgcaaaatgctgggtattggcggagacaggacagaaaaattaataccgggaatggaattaagcaactggctcccaggtggtacttctactacactggaactggacccgaagcagcactcccattccgggctgttaaggatggcatcgtttgggtccatgaagatggcgccactgatgctccttcaacttttgggacgcggaaccctaacaatgattcagctattgttacacaattcgcgcccggtactaagcttcctaaaaacttccacattgaggggactggaggcaatagtcaatcatcttcaagagcctctagcttaagcagaaactcttccagatctagttcacaaggttcaagatcaggaaactctacccgcggcacttctccaggtccatctggaatcggagcagtaggaggtgatctactttaccttgatcttctgaacagactacaagcccttgagtctggcaaagtaaagcaatcgcagccaaaagtaatcactaagaaagatgctgctgctgctaaaaataagatgcgccacaagcgcacttccaccaaaagtttcaacatggtgcaagcttttggtcttcgcggaccaggagacctccagggaaactttggtgatcttcaattgaataaactcggcactgaggacccacgttggccccaaattgctgagcttgctcctacagccagtgcttttatgggtatgtcgcaatttaaacttacccatcagaacaatgatgatcatggcaaccctgtgtacttccttcggtacagtggagccattaaacttgacccaaagaatcccaactacaataagtggttggagcttcttgagcaaaatattgatgcctacaaaaccttccctaagaaggaaaagaaacaaaaggcaccaaaagaagaatcaacagaccaaatgtctgaacctccaaaggagcagcgtgtgcaaggtagcatcactcagcgcactcgcacccgtccaagtgttcagcctggtccaatgattgatgttaacactgattagtgtcactcaaagtaacaagatcgcggcaatcgtttgtgtttggcaaccccatctcaccatcgcttgtccactcttgcacagaatggaatcatgttgtaattacagtgcaataaggtaattataacccatttaattgatagctatgctttattaaagtgtgtagctgtagagagaatgttaaagactgtcacctctgcttgattgcaagtgaacagtgccccccgggaagagctctacagtgtgaaatgtaaataaaaaatagctattattcaattagattaggctaattagatgatttgcaaaaaaaaaaaaaaaaaa

SEQ ID NO: 15 - DNA, 30078 bp, Human coronavirus
  CDS (1)..(30078)
atttaagtgaatagcttggctatctcacttcccctcgttctcttgcagaactttgattttaacgaacttaaataaaagccctgttgtttagcgtatcgttgcacttgtctggtgggattgtggcattaatttgcctgctcatctaggcagtggacatatgctcaacactgggtataattctaattgaatactatttttcagttagagcgtcgtgtctcttgtacgtctcggtcacaatacacggtttcgtccggtgcgtggcaattcggggcacatcatgtctttcgtggctggtgtgaccgcgcaaggtgcgcgcggtacgtatcgagcagcgctcaactctgaaaaacatcaagaccatgtgtctctaactgtgccactctgtggttcaggaaacctggttgaaaaactttcaccatggttcatggatggcgaaaatgcctatgaagtggtgaaggccatgttacttaaaaaggagccacttctctatgtgcccatccggctggctggacacactagacacctcccaggtcctcgtgtgtacctggttgagaggctcattgcttgtgaaaatccattcatggttaaccaattggcttatagctctagtgcaaatggcagcctggttggcacaactttgcagggcaagcctattggtatgttcttcccttatgacatcgaacttgtcacaggaaagcaaaatattctcctgcgcaagtatggccgtggtggttatcactacaccccattccactatgagcgagacaacacctcttgccctgagtggatggacgattttgaggcggatcctaaaggcaaatatgcccagaatctgcttaagaagttgattggcggtgatgtcactccagttgaccaatacatgtgtggcgttgatggaaaacccattagtgcctacgcatttttaatggccaaggatggaataaccaaactggctgatgttgaagcggacgtcgcagcacgtgctgatgacgaaggcttcatcacattaaagaacaatctatatagattggtttggcatgttgagcgtaaagacgttccatatcctaagcaatctatttttactattaatagtgtggtccaaaaggatggtgttgaaaacactcctcctcactattttactcttggatgcaaaattttaacgctcaccccacgcaacaagtggagtggcgtttctgacttgtccctcaaacaaaaactcctttacaccttctatggtaaggagtcacttgagaacccaacctacatttaccactccgcattcattgagtgtggaagttgtggtaatgattcctggcttacagggaatgctatccaagggtttgcctgtggatgtggggcatcatatacagctaatgatgtcgaagtccaatcatctggcatgattaagccaaatgctcttctttgtgctacttgcccctttgctaagggtgatagctgttcttctaattgcaaacattcagttgctcagttggttagttacctttctgaacgctgtaatgttattgctgattctaagtccttcacacttatctttggtggcgtagcttacgcctactttggatgtgaggaaggtactatgtactttgtgcctagagctaagtctgttgtctcaaggattggagactccatctttacaggctgtactggctcttggaacaaggtcactcaaattgctaacatgttcttggaacagactcagcattcccttaactttgtgggagagttcgttgtcaacgatgttgtcctcgcaattctctctggaaccacaactaatgttgacaaaatacgccagcttctcaaaggtgtcacccttgacaagttgcgtgattatttagctgactatgacgtagcagtcactgccggcccattcatggataatgctattaatgttggtggtacaggattacagtatgccgccattactgcaccttatgtagttctcactggcttaggtgagtcctttaagaaagttgcaaccataccgtataaggtttgcaactctgttaaggatactctggcttattatgctcacagcgtgttgtacagagtttttccttatgacatggattctggtgtgtcatcctttagtgaactactttttgattgcgttgatctttcagtagcttctacctattttttagtccgcatcttgcaagataagactggcgactttatgtctacaattattacttcctgccaaactgctgttagtaagcttctagatacatgttttgaagctacagaagcaacatttaacttcttgttagatttggcaggattgttcagaatctttctccgcaatgcctatgtgtacacttcacaagggtttgtggtggtcaatggcaaagtttctacacttgtcaaacaagtgttagacttgcttaataagggtatgcaacttttgcatacaaaggtctcctgggctggttctaaaatcattgctgttatctacagcggcagggagtctctaatattcccatcgggaacctattactgtgtcaccactaaggctaagtccgttcaacaagatcttgacgttattttgcctggtgagttttccaagaagcagttaggactgctccaacctactgacaattctacaactgttagtgttactgtatccagtaacatggttgaaactgttgtgggtcaacttgagcaaactaatatgcatagtcctgatgttatagtaggtgactatgtcattattagtgaaaaattgtttgtgcgtagtaaggaagaagacggatttgccttctaccctgcttgcactaatggtcatgctgtaccgactctctttagacttaagggaggtgcacctagtaaaaaagtagcctttggcggtgatcaagtacatgaggttgctgctgtaagaagtgttactgtcgagtacaacattcatgctgtattagacacactacttgcttcttctagtcttagaacctttgttgtagataagtctttgtcaattgaggagtttgctgacgtagtaaaggaacaagtctcagacttgcttgttaaattactgcgtggaatgccgattccagattttgatttagacgattttattgacgcaccatgctattgctttaacgctgagggtgatgcatcctggtcttctactatgatcttctctcttcaccccgtcgagtgtgacgaggagtgttctgaagtagaggcttcagatttagaagaaggtgaatcagagtgcatttctgagacttcaactgaacaagttgacgtttctcatgagacttctgacgacgagtgggctgctgcagttgatgaagcgttccctctcgatgaagcagaagatgttactgaatctgtgcaagaagaagcacaaccagtagaagtacctgttgaagatattgcgcaggttgtcatagctgacaccttacaggaaactcctgttgtgcctgatactgttgaagtcccaccgcaagtggtgaaacttccgtctgcacctcagactatccagcccgaggtaaaagaagttgcacctgtctatgaggctgataccgaacagacacagaatgttactgttaaacctaagaggttacgcaaaaagcgtaatgttgaccctttgtccaattttgaacataaggttattacagagtgcgttaccatagttttaggtgacgcaattcaagtagccaagtgctatggggagtctgtgttagttaatgctgctaacacacatcttaagcatggcggtggtatcgctggtgctattaatgcggcttcaaaaggggctgtccaaaaagagtcagatgagtatattctggctaaagggccgttacaagtaggagattcagttctcttgcaaggccattctctagctaagaatatcctgcatgtcgtaggcccagatgcccgcgctaaacaggatgtttctctccttagtaagtgctataaggctatgaatgcatatcctcttgtagtcactcctcttgtttcagcaggcatatttggtgtaaaaccagctgtgtcttttgattatcttattagggaggctaagactagagttttagtcgtcgttaattcccaagatgtctataagagtcttaccatagttgacattccacagagtttgactttttcatatgatgggttacgtggcgcaatacgtaaagctaaagattatggttttactgtttttgtgtgcacagacaactctgctaacactaaagttcttaggaacaagggtgttgattatactaagaagtttcttacagttgacggtgtgcaatattattgctacacgtctaaggacactttagatgatatcttacaacaggctaataagtctgttggtattatatctatgcctttgggatatgtgtctcatggtttagacttaatgcaagcagggagtgtcgtgcgtagagttaacgtgccctacgtgtgtctcctagctaataaagagcaagaagctattttgatgtctgaagacgttaagttaaacccttcagaagattttataaagcacgtccgcactaatggtggttacaattcttggcatttagtcgagggtgaactattggtgcaagacttacgcttaaataagctcctgcattggtctgatcaaaccatatgctacaaggatagtgtgttttatgttgtaaagaatagtacagcttttccatttgaaacactttcagcatgtcgtgcgtatttggattcacgcacgacacagcagttaacaatcgaagtcttagtgactgtcgatggtgtaaattttagaacagtcgttctaaataataagaacacttatagatcacagcttggatgcgttttctttaatggtgctgatatttctgacaccattcctgatgagaaacagaatggtcacagtttatatctagcagacaatttgactgctgatgaaacaaaggcgcttaaagagttatatggccccgttgatcctactttcttacacagattctattcacttaaggctgcagtccatgggtggaagatggttgtgtgtgataaggtacgttctctcaaattgagtgataataattgttatcttaatgcagttattatgacacttgatttattgaaggacattaaatttgttatacctgctctacagcatgcatttatgaaacataagggcggtgattcaactgacttcatagccctcattatggcttatggcaattgcacatttggtgctccagatgatgcctctcggttacttcataccgtgcttgcaaaggctgagttatgctgttctgcacgcatggtttggagagagtggtgcaatgtctgtggcataaaagatgttgttctacaaggcttaaaagcttgttgttacgtgggtgtgcaaactgttgaagatctgcgtgctcgcatgacatatgtatgccagtgtggtggtgaacgtcatcggcaattagtcgaacacaccaccccctggttgctgctctcaggcacaccaaatgaaaaattggtgacaacctccacggcgcctgattttgtagcatttaatgtctttcagggcattgaaacggctgttggccattatgttcatgctcgcctgaagggtggtcttattttaaagtttgactctggcaccgttagcaagacttcagactggaagtgcaaggtgacagatgtacttttccccggccaaaaatacagtagcgattgtaatgtcgtacggtattctttggacggtaatttcagaacagaggttgatcccgacctatctgctttctatgttaaggatggtaaatactttacaagtgaaccacccgtaacatattcaccagctacaattttagctggtagtgtctacactaatagctgccttgtatcgtctgatggacaacctggcggtgatgctattagtttgagttttaataaccttttagggtttgattctagtaaaccagtcactaagaaatacacttactccttcttgcctaaagaagacggcgatgtgttgttggctgagtttgacacttatgaccctatttataagaatggtgccatgtataaaggcaaaccaattctttgggtcaataaagcatcttatgatactaatcttaataagttcaatagagctagtttgcgtcaaatttttgacgtagcccccattgaactcgaaaataaattcacacctttgagtgtggagtctacaccagttgaacctccaactgtagatgtggtagcacttcaacaggaaatgacaattgtcaaatgtaagggtttaaataaacctttcgtgaaggacaatgtcagtttcgttgctgatgattcaggtactcccgttgttgagtatctgtctaaagaagacctacatacattgtatgtagaccctaagtatcaagtcattgtcttaaaagacaatgtactttcttctatgcttagattgcacaccgttgagtcaggtgatattaacgttgttgcagcttccggatctttgacacgtaaagtgaagttactatttagggcttcattttatttcaaagaatttgctacccgcactttcactgctaccactgctgtaggtagttgtataaagagtgtagtgcggcatctaggtgttactaaaggcatattgacaggctgttttagttttgccaagatgttatttatgcttccactagcttactttagtgattcaaaactcggcaccacagaggttaaagtgagtgctttgaaaacagccggcgttgtgacaggtaatgttgtaaaacagtgttgcactgctgctgttgatttaagtatggataagttgcgccgtgtggattggaaatcaaccctacggttgttacttatgttatgcacaactatggtattgttgtcttctgtgtatcacttgtatgtcttcaatcaggtcttatcaagtgatgttatgtttgaagatgcccaaggtttgaaaaagttctacaaagaagttagagcttacctaggaatctcttctgcttgtgacggtcttgcttcagcttatagggcgaattcctttgatgtacctacattctgcgcaaaccgttctgcaatgtgtaattggtgcttgattagccaagattccataactcactacccagctcttaagatggttcaaacacatcttagccactatgttcttaacatagattggttgtggtttgcatttgagactggtttggcatacatgctctatacctcggccttcaactggttgttgttggcaggtacattgcattatttctttgcacagacttccatatttgtagactggcggtcatacaattatgctgtgtctagtgccttctggttattcacccacattccaatggcgggtttggtacgaatgtataatttgttagcatgcctttggcttttacgcaagttttatcagcatgtaatcaatggttgcaaagatacggcatgcttgctctgctataagaggaaccgacttactagagttgaagcttctaccgttgtctgtggtggaaaacgtacgttttatatcacagcaaatggcggtatttcattctgtcgtaggcataattggaattgtgtggattgtgacactgcaggtgtggggaataccttcatctgtgaagaagtcgcaaatgacctcactaccgccctacgcaggcctattaacgctacggatagatcacattattatgtggattccgttacagttaaagagactgttgttcagtttaattatcgtagagacggtcaaccattctacgagcggtttcccctctgcgcttttacaaatctagataagttgaagttcaaagaggtctgtaaaactactactggtatacctgaatacaactttatcatctacgactcatcagatcgtggccaggaaagtttagctaggtctgcatgtgtttattattctcaagtcttgtgtaaatcaattcttttggttgactcaagtttggttacttctgttggtgattctagtgaaatcgccactaaaatgtttgattcctttgttaatagtttcgtctcgctgtataatgtcacacgcgataagttggaaaaacttatctctactgctcgtgatggcgtaaggcgaggcgataacttccatagtgtcttaacaacattcattgacgcagcacgaggccccgcaggtgtggagtctgatgttgagaccaatgaaattgttgactctgtgcagtatgctcataaacatgacatacaaattactaatgagagctacaataattatgtaccctcatatgttaaacctgatagtgtgtctaccagcgatttaggtagtctcattgattgtaatgcggcttcagttaaccaaattgtcttgcgtaattctaatggtgcttgcatttggaacgctgctgcatatatgaaactctcggatgcacttaaacgacagattcgcattgcatgccgtaagtgtaatttagctttccggttaaccacctcaaagctacgcgctaatgataatatcttatcagttagattcactgctaacaaaattgttggtggtgctcctacatggtttaatgcgttgcgtgactttacgttaaagggttatgttcttgctaccattattgtgtttctgtgtgctgtactgatgtatttgtgtttacctacattttctatggcacctgttgaattttatgaagaccgcatcttggactttaaagttcttgataatggtatcattagggatgtaaatcctgatgataagtgctttgctaataagcaccggtccttcacacaatggtatcatgagcatgttggtggtgtctatgacaactctatcacatgcccattgacagttgcagtaattgctggagttgctggtgctcgcattccagacgtacctactacattggcttgggtgaacaatcagataattttctttgtttctcgagtctttgctaatacaggcagtgtttgctacactcctatagatgagataccctataagagtttctctgatagtggttgcattcttccatctgagtgcactatgtttagggatgcagagggccgtatgacaccatactgccatgatcctactgttttgcctggggcttttgcgtacagtcagatgaggcctcatgttcgttacgacttgtatgatggtaacatgtttattaaatttcctgaagtagtatttgaaagtacacttaggattactagaactctgtcaactcagtactgccggttcggtagttgtgagtatgcacaagagggtgtttgtattaccacaaatggctcgtgggccatttttaatgaccaccatcttaatagacctggtgtctattgtggctctgattttattgacattgtcaggcggttagcagtatcactgttccagcctattacttatttccaattgactacctcattggtcttgggtataggtttgtgtgcgttcctgactttgctcttctattatattaataaagtaaaacgtgcttttgcagattacacccagtgtgctgtaattgctgttgttgctgctgttcttaatagcttgtgcatctgctttgttacctctataccattgtgtatagtaccttacactgcattgtactattatgctacattctattttactaatgagcctgcatttattatgcatgtttcttggtacattatgttcgggcctatcgttcccatatggatgacctgcgtctatacagttgcaatgtgctttagacacttcttctgggttttagcttattttagtaagaaacatgtagaagtttttactgatggtaagcttaattgtagtttccaggacgctgcctctaatatctttgttattaacaaggacacttatgcagctcttagaaactctttaactaatgatgcctattcacgatttttggggttgtttaacaagtataagtacttctctggtgctatggaaacagccgcttatcgtgaagctgcagcatgtcatcttgctaaagccttacaaacatacagcgagactggtagtgatcttctttaccaaccacccaactgtagcataacctctggcgtgttgcaaagcggtttggtgaaaatgtcacatcccagtggagatgttgaggcttgtatggttcaggttacctgcggtagcatgactcttaatggtctttggcttgacaacacagtctggtgcccacgacacgtaatgtgcccggctgaccagttgtctgatcctaattatgatgccttgttgatttctatgactaatcatagtttcagtgtgcaaaaacacattggcgctccagcaaacttgcgtgttgttggtcatgccatgcaaggcactcttttgaagttgactgtcgatgttgctaaccctagcactccagcctacacttttacaacagtgaaacctggcgcagcatttagtgtgttagcatgctataatggtcgtccgactggtacattcactgttgtaatgcgccctaactacacaattaagggttcctttctgtgtggttcttgtggtagtgttggttacaccaaggagggtagtgtgatcaatttctgttacatgcatcaaatggaacttgctaatggtacacataccggttcagcatttgatggtactatgtatggtgcctttatggataaacaagtgcaccaagttcagttaacagacaaatactgcagtgttaatgtagtagcttggctttacgcagcaatacttaatggttgcgcttggtttgtaaaacctaatcgcactagtgttgtttcttttaatgaatgggctcttgccaaccaattcactgaatttgttggcactcaatccgttgacatgttagctgtcaaaacaggcgttgctattgaacagctgctttatgcgatccaacaactgtatactgggttccagggaaagcaaatccttggcagtaccatgttggaagatgaattcacacctgaggatgttaatatgcagattatgggtgtggttatgcagagtggtgtgagaaaagttacatatggtactgcgcattggttgtttgcgacccttgtctcaacctatgtgataatcttacaagccactaaatttactttgtggaactacttgtttgagactattcccacacagttgttcccactcttatttgtgactatggccttcgttatgttgttggttaaacacaaacacacctttttgacacttttcttgttgcctgtggctatttgtttgacttatgcaaacatagtctacgagcccactactcccatttcgtcagcgctgattgcagttgcaaattggcttgcccccactaatgcttatatgcgcactacacatactgatattggtgtctacattagtatgtcacttgtattagtcattgtagtgaagagattgtacaacccatcactttctaactttgcgttagcattgtgcagtggtgtaatgtggttgtacacttatagcattggagaagcctcaagccccattgcctatctggtttttgtcactacactcactagtgattatacgattacagtctttgttactgtcaaccttgcaaaagtttgcacttatgccatctttgcttactcaccacagcttacacttgtgtttccggaagtgaagatgatacttttattatacacatgtttaggtttcatgtgtacttgctattttggtgtcttctctcttttgaaccttaagcttagagcacctatgggtgtctatgactttaaggtctcaacacaagagttcagattcatgactgctaacaatctaactgcacctagaaattcttgggaggctatggctctgaactttaagttaataggtattggcggtacaccttgtataaaggttgctgctatgcagtctaaacttacagatcttaaatgcacatctgtggttctcctctctgtgctccaacagttacacttagaggctaatagtagggcctgggctttctgtgttaaatgccataatgatatattggcagcaacagaccccagtgaggctttcgagaaattcgtaagtctctttgctactttaatgactttttctggtaatgtagatcttgatgcgttagctagtgatatttttgacactcctagcgtacttcaagctactctttctgagttttcacacttagctacctttgctgagttggaagctgcgcagaaagcctatcaggaagctatggactctggtgacacctcaccacaagttcttaaggctttgcagaaggctgttaatatagctaaaaacgcctatgagaaggataaggcagtggcccgtaagttagaacgtatggctgatcaggctatgacttctatgtataagcaagcacgtgctgaagacaagaaagcaaaaattgtcagtgctatgcaaactatgttgtttggtatgattaagaagctcgacaacgatgttcttaatggtatcatttctaacgctaggaatggttgtatacctcttagtgtcatcccactgtgtgcttcaaataaacttcgcgttgtaattcctgacttcaccgtctggaatcaggtagtcacatatccctcgcttaactacgctggggctttgtgggacattacagttataaacaatgtggacaatgaaattgttaagtcttcagatgttgtagacagcaatgaaaatttaacatggccacttgttttagaatgcactagggcatccacttctgccgttaagttgcaaaataatgagatcaaaccttcaggtctaaaaaccatggttgtgtctgcgggtcaagagcaaactaactgtaatactagttccttagcttattacgaacctgtgcagggtcgtaaaatgctgatggctcttctttctgataatgcctatctcaaatgggcgcgtgttgaaggtaaggacggatttgtcagtgtagagctacaacctccttgcaaattcttgattgcgggaccaaaaggacctgaaatccgatatctctattttgttaaaaatcttaacaaccttcatcgcgggcaagtgttagggcacattgctgcgactgttagattgcaagctggttctaacaccgagtttgcctctaattcctcggtgttgtcacttgttaacttcaccgttgatcctcaaaaagcttatctcgatttcgtcaatgcgggaggtgccccattgacaaattgtgttaagatgcttactcctaaaactggtacaggtatagctatatctgttaaaccagagagtacagctgatcaagagacttatggtggagcttcagtgtgtctctattgccgtgcgcatatagaacatcctgatgtctctggtgtttgtaaatataagggtaagtttgtccaaatccctgctcagtgtgtccgtgaccctgtgggattttgtttgtcaaataccccctgtaatgtctgtcaatattggattggatatgggtgcaattgtgactcgcttaggcaagcagcactgccccaatctaaagattccaattttttaaacgagtccggggttctattgtaaatgcccgaatagaaccctgttcaagtggtttgtccactgatgtcgtctttagggcatttgacatctgcaactataaggctaaggttgctggtattggaaaatactacaagactaatacttgtaggtttgtagaattagatgaccaagggcatcatttagactcctattttgtcgttaagaggcatactatggagaattatgaactagagaagcactgttacgacttgttacgtgactgtgatgctgtagctccccatgatttcttcatctttgatgtagacaaagttaaaacacctcatattgtacgtcagcgtttaactgagtacactatgatggatcttgtatatgccctgaggcactttgatcaaaatagcgaagtgcttaaggctatcttagtgaagtatggttgctgtgatgttacctactttgaaaataaactctggtttgattttgttgaaaatcccagtgttattggtgtttatcataaacttggagaacgtgtacgccaagctatcttaaacactgttaaattttgtgaccacatggtcaaggctggtttagtcggtgtgctcacactagacaaccaggaccttaatggcaagtggtatgattttggtgacttcgtaatcactcaacctggttcaggagtagctatagttgatagctactattcttatttgatgcctgtgctctcaatgaccgattgtctggccgctgagacacatagggattgtgattttaataaaccactcattgagtggccacttactgagtatgattttactgattataaggtacaactctttgagaagtactttaaatattgggatcagacgtatcacgcaaattgcgttaattgtactgatgaccgttgtgtgttacattgtgctaatttcaatgtattgtttgctatgaccatgcctaagacttgtttcggacccatagtccgaaagatctttgttgatggcgtgccatttgtagtatcttgtggttatcactacaaagaattaggtttagtcatgaatatggatgttagtctccatagacataggctctctcttaaggagttgatgatgtatgccgctgatccagccatgcacattgcctcctctaacgcttttcttgatttgaggacatcatgttttagtgtcgctgcacttacaactggtttgacttttcaaactgtgcggcctggcaattttaaccaagacttctatgatttcgtggtatctaaaggtttctttaaggagggctcttcagtgacgctcaaacattttttctttgctcaagatggtaatgctgctattacagattataattactattcttataatctgcctactatgtgtgacatcaaacaaatgttgttctgcatggaagttgtaaacaagtacttcgaaatctatgacggtggttgtcttaatgcttctgaagtggttgttaataatttagacaagagtgctggccatccttttaataagtttggcaaagctcgtgtctattatgagagcatgtcttaccaggagcaagatgaactttttgccatgacaaagcgtaacgtcattcctaccatgactcaaatgaatctaaaatatgctattagtgctaagaatagagctcgcactgttgcaggcgtgtccatacttagcacaatgactaatcgccagtaccatcagaaaatgcttaagtccatggctgcaactcgtggagcgacttgcgtcattggtactacaaagttctacggtggctgggatttcatgcttaaaacattgtacaaagatgttgataatccgcatcttatgggttgggattaccctaagtgtgatagagctatgcctaatatgtgtagaatcttcgcttcactcatattagctcgtaaacatggcacttgttgtactacaagggacagattttatcgcttggcaaatgagtgtgctcaggtgctaagcgaatatgttctatgtggtggtggttactacgtcaaacctggaggtaccagtagcggagatgccaccactgcatatgccaatagtgtctttaacattttgcaggcgacaactgctaatgtcagtgcacttatgggtgctaatggcaacaagattgttgacaaagaagttaaagacatgcagtttgatttgtatgtcaatgtttacaggagcactagcccagaccccaaatttgttgataaatactatgcttttcttaataagcacttttctatgatgatactgtctgatgacggtgtcgtttgctataatagtgattatgcagctaagggttacattgctggaatacagaattttaaggaaacgctgtattatcagaacaatgtctttatgtctgaagctaaatgctgggtggaaaccgatctgaagaaagggccacatgaattctgttcacagcatacgctttatattaaggatggcgacgatggttacttccttccttatccagacccttcaagaattttgtctgccggttgctttgtagatgatatcgttaagactgacggtacactcatggtagagcggtttgtgtctttggctatagatgcttaccctctcacaaagcatgaagatatagaataccagaatgtattctgggtctacttacagtatatagaaaaactgtataaagaccttacaggacacatgcttgacagttattctgtcatgctatgtggtgataattctgctaagttttgggaagaggcattctatagagatctctatagttcgcctaccactttgcaggctgtcggttcatgcgttgtatgccattcacagacttccctacgctgtgggacatgcatccgtagaccatttctctgctgtaaatgctgctatgatcatgttatagcaactccacataagatggttttgtctgtttctccttacgtttgtaatgcccctggttgtggcgtttcagacgttactaagctatatttaggtggtatgagctacttttgtgtagatcatagacctgtgtgtagttttccactttgcgctaatggtcttgtattcggcttatacaagaatatgtgcacaggtagtccttctatagttgaatttaataggttggctacctgtgactggactgaaagtggtgattacacccttgccaatactacaacagaaccactcaaactttttgctgctgagactttacgtgccactgaagaggcgtctaagcagtcttatgctattgccaccatcaaagaaattgttggtgagcgccaactattacttgtgtgggaggctggcaagtccaaaccaccactcaatcgtaattatgtttttactggttatcatataaccaaaaatagtaaagtgcagctcggtgagtacattttcgagcgcattgattatagtgatgctgtatcctacaagtctagtacaacgtataaactgactgtaggtgacatcttcgtacttacctctcactctgtggctaccttgacggcgcccacaattgtgaatcaagagaggtatgttaaaattactgggttgtacccaaccattacggtacctgaagagttcgcaagtcatgttgccaacttccaaaaatcaggttatagtaaatatgtcactgttcagggaccacctggcactggcaaaagtcattttgctatagggttagcgatttactaccctacagcacgtgttgtttatacagcatgttcacacgcagctgttgatgctttgtgtgaaaaagcttttaaatatttgaacattgctaaatgttcccgtatcattcctgcaaaggcacgtgttgagtgctatgacaggtttaaagttaatgagacaaattctcaatatttgtttagtactattaatgctctaccagaaacttctgccgatattctggtggttgatgaggttagtatgtgcactaattatgatctttcaattattaatgcacgtattaaagctaagcacattgtctatgtaggagatccagcacagttgccagctcctaggactttgttgactagaggcacattggaaccagaaaatttcaatagtgtcactagattgatgtgtaacttaggtcctgacatatttttaagtatgtgctacaggtgtcctaaggaaatagtaagcactgtgagcgctcttgtctacaataataaattgttagccaagaaggagctttcaggccagtgctttaaaatactctataagggcaatgtgacgcatgatgctagctctgccattaatagaccacaactcacatttgtgaagaattttattactgccaatccggcatggagtaaggcagtctttatttcgccttacaattcacagaatgctgtgtctcgttcaatgctgggtcttaccactcagactgttgattcctcacagggttcagaataccagtacgttatcttctgtcaaacagcagatacggcacatgctaacaacattaacagatttaatgttgcaatcactcgtgcccaaaaaggtattctttgtgttatgacatctcaggcactctttgagtccttagagtttactgaattgtcttttactaattacaagctccagtctcagattgtaactggcctttttaaagattgctctagagaaacttctggcctctcacctgcttatgcaccaacatatgttagtgttgatgacaagtataagacgagtgatgagctttgcgtgaatcttaatttacccgcaaatgtcccatactctcgtgttatttccaggatgggctttaaactcgatgcaacagttcctggatatcctaagcttttcattactcgtgaagaggctgtaaggcaagttcgaagctggataggcttcgatgttgagggtgctcatgcttcccgtaatgcatgtggcaccaatgtgcctctacaattaggattttcaactggtgtgaactttgttgttcagccagttggtgttgtagacactgagtggggtaacatgttaacgggcattgctgcacgtcctccaccaggtgaacagtttaagcacctcgtgcctcttatgcataagggggctgcgtggcctattgttagacgacgtatagtgcaaatgttgtcagacactttagacaaattgtctgattactgtacgtttgtttgttgggctcatggctttgaattaacgtctgcatcatacttttgcaagataggtaaggaacagaagtgttgcatgtgcaatagacgcgctgcagcgtactcttcacctctgcaatcttatgcctgctggactcattcctgcggttatgattatgtctacaaccctttctttgtcgatgttcaacagtggggttatgtaggcaatcttgctactaatcacgatcgttattgctctgtccatcaaggagctcatgtggcttctaatgatgcaataatgactcgttgtttagctattcattcttgttttatagaacgtgtggattgggatatagagtatccttatatctcacatgaaaagaaattgaattcctgttgtagaatcgttgagcgcaacgtcgtacgtgctgctcttcttgccggttcatttgacaaagtctatgatattggcaatcctaaaggaattcctattgttgatgaccctgtggttgattggcattattttgatgcacagcccttgaccaggaaggtacaacagcttttctatacagaggacatggcctcaagatttgctgatgggctctgcttattttggaactgtaatgtaccaaaatatcctaataatgcaattgtatgcaggtttgacacacgtgtgcattctgagttcaatttgccaggttgtgatggcggtagtttgtatgttaacaagcacgcttttcatacaccagcatatgatgtgagtgcattccgtgatctgaaacctttaccattcttttattattctactacaccatgtgaagtgcatggtaatggtagtatgatagaggatattgattatgtacccctaaaatctgcagtctgtattacagcttgtaatttagggggcgctgtttgtaggaagcatgctacagagtacagagagtatatggaagcatataatcttgtctctgcatcaggtttccgcctttggtgttataagacctttgatatttataatctctggtctacttttacaaaagttcaaggtttggaaaacattgcttttaatgttgttaaacaaggccattttattggtgttgagggtgaactacctgtagctgtagtcaatgataagatcttcaccaagagtggcgttaatgacatttgtatgtttgagaataaaaccactttgcctactaatatagcttttgaactctatgctaagcgtgctgtacgctcgcatcccgatttcaaattgctacacaatttacaagcagacatttgctacaagttcgtcctttgggattatgaacgtagcaatatttatggtactgctactattggtgtatgtaagtacactgatattgatgttaattcagctttgaatatatgttttgacatacgcgataattgttcattggagaagttcatgtctactcccaatgccatctttatttctgatagaaaaatcaagaaatacccttgtatggtaggtcctgattatgcttacttcaatggtgctatcatccgtgatagtgatgttgttaaacaaccagtgaagttctacttgtataagaaagtcaataatgagtttattgatcctactgagtgtatttacactcagagtcgctcttgtagtgacttcctacccctttctgacatggagaaagactttctatcttttgatagtgatgttttcattaagaagtatggcttggaaaactatgcttttgagcacgtagtctatggagacttctctcatactacgttaggcggtcttcacttgcttattggtttatacaagaagcaacaggaaggtcatattattatggaagaaatgctaaaaggtagctcaactattcataactattttattactgagactaacacagcggcttttaaggcggtgtgttctgttatagatttaaagcttgacgactttgttatgattttaaagagtcaagaccttggcgtagtatccaaggttgtcaaggttcctattgacttaacaatgattgagtttatgttatggtgtaaggatggacaggttcaaaccttctaccctcgactccaggcttctgcagattggaaacctggtcatgcaatgccatccctctttaaagttcaaaatgtaaaccttgaacgttgtgagcttgctaattacaagcaatctattcctatgcctcgcggtgtgcacatgaacatcgctaaatatatgcaattgtgccagtatttaaatacttgcacattagccgtgcctgccaatatgcgtgttatacattttggcgctggttctgataaaggtatcgctcctggtacctcagttttacgacagtggcttcctacagatgccattattatagataatgatttaaatgagttcgtgtcagatgctgacataactttatttggagattgtgtaactgtacgtgtcggccaacaagtggatcttgttatttccgacatgtatgatcctactactaagaatgtaacaggtagtaatgagtcaaaggctttattctttacttacctgtgtaacctcattaataataatcttgctcttggtgggtctgttgctattaaaataacagaacactcttggagcgttgaactttatgaacttatgggaaaatttgcttggtggactgttttctgcaccaatgcaaatgcatcctcatctgaaggattcctcttaggtattaattacttgggtactattaaagaaaatatagatggtggtgctatgcacgccaactatatattttggagaaattccactcctatgaatctgagtacttactcactttttgatttatccaagtttcaattaaaattaaaaggaacaccagttcttcaattaaaggagagtcaaattaacgaactcgtaatatctctcctgtcgcagggtaagttacttatccgtgacaatgatacactcagtgtttctactgatgttcttgttaacacctacagaaagttacgttgatgtagggccagattctgttaagtctgcttgtattgaggttgatatacaacagactttctttgataaaacttggcctaggccaattgatgtttctaaggctgacggtattatataccctcaaggccgtacatattctaacataactatcacttatcaaggtctttttccctatcagggagaccatggtgatatgtatgtttactctgcaggacatgctacaggcacaactccacaaaagttgtttgtagctaactattctcaggacgtcaaacagtttgctaatgggtttgtcgtccgtataggagcagctgccaattccactggcactgttattattagcccatctaccagcgctactatacgaaaaatttaccctgcttttatgctgggttcttcagttggtaatttctcagatggtaaaatgggccgcttcttcaatcatactctagttcttttgcccgatggatgtggcactttacttagagctttttattgtattctagagcctcgctctggaaatcattgtcctgctggcaattcctatacttcttttgccacttatcacactcctgcaacagattgttctgatggcaattacaatcgtaatgccagtctgaactcttttaaggagtattttaatttacgtaactgcacctttatgtacacttataacattaccgaagatgagattttagagtggtttggcattacacaaactgctcaaggtgttcacctcttctcatctcggtatgttgatttgtacggcggcaatatgtttcaatttgccaccttgcctgtttatgatactattaagtattattctatcattcctcacagtattcgttctatccaaagtgatagaaaagcttgggctgccttctacgtatataaacttcaaccgttaactttcctgttggatttttctgttgatggttatatacgcagagctatagactgtggttttaatgatttgtcacaactccactgctcatatgaatccttcgatgttgaatctggagtttattcagtttcgtctttcgaagcaaaaccttctggctcagttgtggaacaggctgaaggtgttgaatgtgatttttcacctcttctgtctggcacacctcctcaggtttataatttcaagcgtttggtttttaccaattgcaattataatcttaccaaattgctttcacttttttctgtgaatgattttacttgtagtcaaatatctccagcagcaattgctagcaactgttattcttcactgattttggattacttttcatacccacttagtatgaaatccgatctcagtgttagttctgctggtccaatatcccagtttaattataaacagtccttttctaatcccacatgtttgattttagcgactgttcctcataaccttactactattactaagcctcttaagtacagctatattaacaagtgctctcgtcttctttctgatgatcgtactgaagtacctcagttagtgaacgctaatcaatactcaccctgtgtatccattgtcccatccactgtgtgggaagacggtgattattataggaaacaactatctccacttgaaggtggtggctggcttgttgctagtggctcaactgttgccatgactgagcaattacagatgggctttggtattacagttcaatatggtacagacaccaatagtgtttgccccaagcttgaatttgctaatgacacaaaaattgcctctcaattaggcaattgcgtggaatattccctctatggtgtttcgggccgtggtgtttttcagaattgcacagctgtaggtgttcgacagcagcgctttgtttatgatgcgtaccagaatttagttggctattattctgatgatggcaactactactgtttgcgtgcttgtgttagtgttcctgtttctgtcatctatgataaagaaactaaaacccacgctactctatttggtagtgttgcatgtgaacacatttcttctaccatgtctcaatactcccgttctacgcgatcaatgcttaaacggcgagattctacatatggcccccttcagacacctgttggttgtgtcctaggacttgttaattcctctttgttcgtagaggactgcaagttgcctcttggtcaatctctctgtgctcttcctgacacacctagtactctcacacctcgcagtgtgcgctctgttccaggtgaaatgcgcttggcatccattgcttttaatcatcctattcaggttgatcaacttaatagtagttattttaaattaagtatacccactaatttttcctttggtgtgactcaggagtacattcagacaaccattcagaaagttactgttgattgtaaacagtacgtttgcaatggtttccagaagtgtgagcaattactgcgcgagtatggccagttttgttccaaaataaaccaggctctccatggtgccaatttacgccaggatgattctgtacgtaatttgtttgcgagcgtgaaaagctctcaatcatctcctatcataccaggttttggaggtgactttaatttgacacttctagaacctgtttctatatctactggcagtcgtagtgcacgtagtgctattgaggatttgctatttgacaaagtcactatagctgatcctggttatatgcaaggttacgatgattgcatgcagcaaggtccagcatcagctcgtgatcttatttgtgctcaatatgtggctggttacaaagtattacctcctcttatggatgttaatatggaagccgcgtatacttcatctttgcttggcagcatagcaggtgttggctggactgctggcttatcctcctttgctgctattccatttgcacagagtatcttttataggttaaacggtgttggcattactcaacaggttctttcagagaaccaaaagcttattgccaataagtttaatcaggctctgggagctatgcaaacaggcttcactacaactaatgaagcttttcagaaggttcaggatgctgtgaacaacaatgcacaggctctatccaaattagctagcgagctatctaatacttttggtgctatttccgcctctattggagacatcatacaacgtcttgatgttctcgaacaggacgcccaaatagacagacttattaatggccgtttgacaacactaaatgcttttgttgcacagcagcttgttcgttccgaatcagctgctctttccgctcaattggctaaagataaagtcaatgagtgtgtcaaggcacaatccaagcgttctggattttgcggtcaaggcacacatatagtgtcctttgttgtaaatgcccctaatggcctttacttcatgcatgttggttattaccctagcaaccacattgaggttgtttctgcttatggtctttgcgatgcagctaaccctactaattgtatagcccctgttaatggctactttattaaaactaataacactaggattgttgatgagtggtcatatactggctcgtccttctatgcacctgagcccattacctcccttaatactaagtatgttgcaccacaggtgacataccaaaacatttctactaacctccctcctcctcttctcggcaattccaccgggattgacttccaagatgagttggatgagtttttcaaaaatgttagcaccagtatacctaattttggttccctaacacagattaatactacattactcgatcttacctacgagatgttgtctcttcaacaagttgttaaagcccttaatgagtcttacatagaccttaaagagcttggcaattatacttattacaacaaatggccgtggtacatttggcttggtttcattgctgggcttgttgccttagctctatgcgtcttcttcatactgtgctgcactggttgtggcacaaactgtatgggaaaacttaagtgtaatcgttgttgtgatagatacgaggaatacgacctcgagccgcataaggttcatgttcactaattaacgaactattaatgagagttcaaagaccacccactctcttgttagtgttttcactctctcttttggtcactgcatcctcaaaacctctctatgtacctgagcattgtcagaattattctggttgcatgcttagggcttgtattaaaactgcccaagctgatacagctggtctttatacaaattttcgaattgacgtcccatctgcagaatcaactggtactcaatcagtttctgtcgatcttgagtcaacttcaactcatgatggtcctaccgaacatgttactagtgtgaatctttttgacgttggttactcagttaattaacgaactctatggattacgtgtctctgcttaatcaaatttggcagaagtaccttaactcaccgtatactacttgtttgtacatccctaaacccacagctaagtatacacctttagttggcacttcattgcaccctgtgctgtggaactgtcagctatcctttgctggttatactgaatctgctgttaattctacaaaagctttggccaaacaggacgcagctcagcgaatcgcttggttgctacataaggatggaggaatccctgatggatgttccctctacctccggcactcaagtttattcgcgcaaagcgaggaagaggagccattctccaactaagaaactgcgctacgttaagcgtagattttctcttctgcgccatgaagaccttagtgttattgtccaaccaacacactatgtcagggttacattttcagaccccaacatgtggtatctacgttcgggtcatcatttacactcagttcacaattggcttaaaccttatggcggccaacctgtttctgagtaccatattactctagctttgctaaatctcactgatgaagatttagctagagatttttcacccattgcgctctttttgcgcaatgtcagatttgagctacatgagttcgccttgctgcgcaaaactcttgttcttaatgcatcagagatctactgtgctaacatacatagatttaagcctgtgtatagagttaacacggcaatccctactattaaggattggcttctcgttcagggattttccctttaccatagtggcctccctttacatatgtcaatctctaaattgcatgcactggatgatgttactcgcaattacatcattacaatgccatgctttagaacttaccctcaacaaatgtttgttactcctttggccgtagatgttgtctccatacggtcttccaatcagggtaataaacaaattgttcattcttatcccattttacatcatccaggattttaacgaactatggctttctcggcgtctttatttaaacccgtccagctagtcccagtttctcctgcatttcatcgcattgagtctactgactctattgttttcacatacattcctgctagcggctatgtagctgctttagctgtcaatgtgtgtctcattcccctattattactgctacgtcaagatacttgtcgtcgcagcattatcagaactatggttctctatttccttgttctgtataactttttattagccattgtactagtcaatggtgtacattatccaactggaagttgcctgatagccttcttagttatcctcataatactttagtttgtagatagaattcgtttctgtctcatgctgaattcctacattccactgtttgacatgcgttcccactttattcgtgttagtacagtttcttctcatggtatggtccctgtaatacacaccaaaccattatttattagaaacttcgatcagcgttgcagctgttctcgttgtttttatttgcactcttccacttatatagagtgcacttatattagccgttttagtaagattagcctagtttctgtaactgacttctccttaaacggcaatgtttccactgttttcgtgcctgcaacgcgcgattcagttcctcttcacataatcgccccgagctcgcttatcgtttaagcagctctgcgctactatgggtcccgtgtagaggctaatccattagtctctctttggacatatggaaaacgaactatgttaccctttgtccaagaacgaatagggttgttcatagtaaactttttcatttttaccgtagtatgtgctataacactcttggtgtgtatggctttccttacggctactagattatgtgtgcaatgtatgacaggcttcaataccctgttagttcagcccgcattatacttgtataatactggacgttcagtctatgtaaaattccaggatagtaaaccccctctaccacctgacgagtgggtttaacgaactccttcataatgtctaatatgacgcaactcactgaggcgcagattattgccattattaaagactggaactttgcatggtccctgatctttctcttaattactatcgtactacagtatggatacccatcccgtagtatgactgtctatgtctttaaaatgtttgttttatggctcctatggccatcttccatggcgctatcaatatttagcgccgtttatccaattgatctagcttcccagataatctctggcattgtagcagctgtttcagctatgatgtggatttcctactttgtgcagagtatccggctgtttatgagaactggatcatggtggtcattcaatcctgagactaattgccttttgaacgttccatttggtggtacaactgtcgtacgtccactcgtagaggactctaccagtgtaactgctgttgtaaccaatggccacctcaaaatggctggcatgcatttcggtgcttgtgactacgacagacttcctaatgaagtcaccgtggccaaacccaatgtgctgattgctttaaaaatggtgaagcggcaaagctacggaactaattccggcgttgccatttaccatagatataaggcaggtaattacaggagtccgcctattacggcggatattgaacttgcattgcttcgagcttaggctctttagtaagagtatcttaattgattttaacgaatctcaatttcattgttatggcatcccctgctgcacctcgtgctgtttcctttgccgataacaatgatataacaaatacaaacctatctcgaggtagaggacgtaatccaaaaccacgagctgcaccaaataacactgtctcttggtacactgggcttacccaacacgggaaagtccctcttacctttccacctgggcagggtgtacctcttaatgccaattctacccctgcgcaaaatgctgggtattggcggagacaggacagaaaaattaataccgggaatggaattaagcaactggctcccaggtggtacttctactacactggaactggacccgaagcagcactcccattccgggctgttaaggatggcatcgtttgggtccatgaagatggcgccactgatgctccttcaacttttgggacgcggaaccctaacaatgattcagctattgttacacaattcgcgcccggtactaagcttcctaaaaacttccacattgaggggactggaggcaatagtcaatcatcttcaagagcctctagcttaagcagaaactcttccagatctagttcacaaggttcaagatcaggaaactctacccgcggcacttctccaggtccatctggaatcggagcagtaggaggtgatctactttaccttgatcttctgaacagactacaagcccttgagtctggcaaagtaaagcaatcgcagccaaaagtaatcactaagaaagatgctgctgctgctaaaaataagatgcgccacaagcgcacttccaccaaaagtttcaacatggtgcaagcttttggtcttcgcggaccaggagacctccagggaaactttggtgatcttcaattgaataaactcggcactgaggacccacgttggccccaaattgctgagcttgctcctacagccagtgcttttatgggtatgtcgcaatttaaacttacccatcagaacaatgatgatcatggcaaccctgtgtacttccttcggtacagtggagccattaaacttgacccaaagaatcccaactacaataagtggttggagcttcttgagcaaaatattgatgcctacaaaaccttccctaagaaggaaaagaaacaaaaggcaccaaaagaagaatcaacagaccaaatgtctgaacctccaaaggagcagcgtgtgcaaggtagcatcactcagcgcactcgcacccgtccaagtgttcagcctggtccaatgattgatgttaacactgattagtgtcactcaaagtaacaagatcgcggcaatcgtttgtgtttggcaaccccatctcaccatcgcttgtccactcttgcacagaatggaatcatgttgtaattacagtgcaataaggtaattataacccatttaattgatagctatgctttattaaagtgtgtagctgtagagagaatgttaaagactgtcacctctgcttgattgcaagtgaacagtgccccccgggaagagctctacagtgtgaaatgtaaataaaaaatagctattattca

SEQ ID NO: 16 - protein, 22 aa, Human coronavirus
VNSLAISLPLVLLQNFDFNELK

SEQ ID NO: 17 - protein, 17 aa, Human coronavirus
KPCCLAYRCTCLVGLWH

SEQ ID NO: 18 - protein, 15 aa, Human coronavirus
FACSSRQWTYAQHWV

SEQ ID NO: 19 - protein, 53 aa, Human coronavirus
LNTIFQLERRVSCTSRSQYTVSSGAWQFGAHHVFRGWCDRARCARYVSSSAQL

SEQ ID NO: 20 - protein, 19 aa, Human coronavirus
KTSRPCVSNCATLWFRKPG

SEQ ID NO: 21 - protein, 13 aa, Human coronavirus
KTFTMVHGWRKCL

SEQ ID NO: 22 - protein, 7 aa, Human coronavirus
SGEGHVT

SEQ ID NO: 23 - protein, 15 aa, Human coronavirus
KGATSLCAHPAGWTH

SEQ ID NO: 24 - protein, 10 aa, Human coronavirus
TPPRSSCVPG

SEQ ID NO: 25 - protein, 5 aa, Human coronavirus
EAHCL

SEQ ID NO: 26 - protein, 5 aa, Human coronavirus
KSIHG

SEQ ID NO: 27 - protein, 4 aa, Human coronavirus
PIGL

SEQ ID NO: 28 - protein, 21 aa, Human coronavirus
CKWQPGWHNFAGQAYWYVLPL

SEQ ID NO: 29 - protein, 27 aa, Human coronavirus
HRTCHRKAKYSPAQVWPWWLSLHPIPL

SEQ ID NO: 30 - protein, 7 aa, Human coronavirus
ARQHLLP

SEQ ID NO: 31 - protein, 5 aa, Human coronavirus
VDGRF

SEQ ID NO: 32 - protein, 8 aa, Human coronavirus
RQICPESA

SEQ ID NO: 33 - protein, 5 aa, Human coronavirus
EVDWR

SEQ ID NO: 34 - protein, 4 aa, Human coronavirus
CHSS

SEQ ID NO: 35 - protein, 6 aa, Human coronavirus
PIHVWR

SEQ ID NO: 36 - protein, 4 aa, Human coronavirus
WKTH

SEQ ID NO: 37 - protein, 15 aa, Human coronavirus
CLRIFNGQGWNNQTG

SEQ ID NO: 38 - protein, 7 aa, Human coronavirus
SGRRSTC

SEQ ID NO: 39 - protein, 11 aa, Human coronavirus
RRLHHIKEQSI

SEQ ID NO: 40 - protein, 5 aa, Human coronavirus
IGLAC

SEQ ID NO: 41 - protein, 5 aa, Human coronavirus
RRSIS

SEQ ID NO: 42 - protein, 6 aa, Human coronavirus
AIYFYY

SEQ ID NO: 43 - protein, 7 aa, Human coronavirus
CGPKGWC

SEQ ID NO: 44 - protein, 26 aa, Human coronavirus
KHSSSLFYSWMQNFNAHPTQQVEWRF

SEQ ID NO: 45 - protein, 13 aa, Human coronavirus
LVPQTKTPLHLLW

SEQ ID NO: 46 - protein, 11 aa, Human coronavirus
EPNLHLPLRIH

SEQ ID NO: 47 - protein, 5 aa, Human coronavirus
VWKLW

SEQ ID NO: 48 - protein, 21 aa, Human coronavirus
FLAYRECYPRVCLWMWGIIYS

SEQ ID NO: 49 - protein, 9 aa, Human coronavirus
CRSPIIWHD

SEQ ID NO: 50 - protein, 12 aa, Human coronavirus
AKCSSLCYLPLC

SEQ ID NO: 51 - protein, 9 aa, Human coronavirus
LQTFSCSVG

SEQ ID NO: 52 - protein, 16 aa, Human coronavirus
VLHTYLWWRSLRLLWM

SEQ ID NO: 53 - protein, 8 aa, Human coronavirus
GRYYVLCA

SEQ ID NO: 54 - protein, 25 aa, Human coronavirus
VCCLKDWRLHLYRLYWLLEQGHSNC

SEQ ID NO: 55 - protein, 10 aa, Human coronavirus
HVLGTDSAFP

SEQ ID NO: 56 - protein, 20 aa, Human coronavirus
LCGRVRCQRCCPRNSLWNHN

SEQ ID NO: 57 - protein, 11 aa, Human coronavirus
QNTPASQRCHP

SEQ ID NO: 58 - protein, 10 aa, Human coronavirus
RSSHCRPIHG

SEQ ID NO: 59 - protein, 22 aa, Human coronavirus
CWWYRITVCRHYCTLCSSHWLR

SEQ ID NO: 60 - protein, 7 aa, Human coronavirus
ESCNHTV

SEQ ID NO: 61 - protein, 5 aa, Human coronavirus
GLQLC

SEQ ID NO: 62 - protein, 17 aa, Human coronavirus
GYSGLLCSQRVVQSFSL

SEQ ID NO: 63 - protein, 8 aa, Human coronavirus
HGFWCVIL

SEQ ID NO: 64 - protein, 15 aa, Human coronavirus
SFSSFYLFFSPHLAR

SEQ ID NO: 65 - protein, 16 aa, Human coronavirus
DWRLYVYNYYFLPNCC

SEQ ID NO: 66 - protein, 6 aa, Human coronavirus
ASRYMF

SEQ ID NO: 67 - protein, 6 aa, Human coronavirus
SYRSNI

SEQ ID NO: 68 - protein, 42 aa, Human coronavirus
LLVRFGRIVQNLSPQCLCVHFTRVCGGQWQSFYTCQTSVRLA

SEQ ID NO: 69 - protein, 14 aa, Human coronavirus
GYATFAYKGLLGWF

SEQ ID NO: 70 - protein, 24 aa, Human coronavirus
NHCCYLQRQGVSNIPIGNLLLCHH

SEQ ID NO: 71 - protein, 6 aa, Human coronavirus
VRSTRS

SEQ ID NO: 72 - protein, 5 aa, Human coronavirus
RYFAW

SEQ ID NO: 73 - protein, 12 aa, Human coronavirus
VFQEAVRTAPTY

SEQ ID NO: 74 - protein, 5 aa, Human coronavirus
QFYNC

SEQ ID NO: 75 - protein, 5 aa, Human coronavirus
CYCIQ

SEQ ID NO: 76 - protein, 6 aa, Human coronavirus
NCCGST

SEQ ID NO: 77 - protein, 4 aa, Human coronavirus
CYSR

SEQ ID NO: 78 - protein, 4 aa, Human coronavirus
LCHY

SEQ ID NO: 79 - protein, 5 aa, Human coronavirus
KIVCA

SEQ ID NO: 80 - protein, 12 aa, Human coronavirus
GRRRICLLPCLH

SEQ ID NO: 81 - protein, 8 aa, Human coronavirus
WSCCTDSL

SEQ ID NO: 82 - protein, 4 aa, Human coronavirus
GRCT

SEQ ID NO: 83 - protein, 6 aa, Human coronavirus
KSSLWR

SEQ ID NO: 84 - protein, 24 aa, Human coronavirus
GCCCKKCYCRVQHSCCIRHTTCFF

SEQ ID NO: 85 - protein, 5 aa, Human coronavirus
NLCCR

SEQ ID NO: 86 - protein, 4 aa, Human coronavirus
VFVN

SEQ ID NO: 87 - protein, 11 aa, Human coronavirus
RSKGTSLRLAC

SEQ ID NO: 88 - protein, 10 aa, Human coronavirus
ITAWNADSRF

SEQ ID NO: 89 - protein, 5 aa, Human coronavirus
FRRFY

SEQ ID NO: 90 - protein, 6 aa, Human coronavirus
RTMLLL

SEQ ID NO: 91 - protein, 16 aa, Human coronavirus
CILVFYYDLLSSPRRV

SEQ ID NO: 92 - protein, 4 aa, Human coronavirus
RGVF

SEQ ID NO: 93 - protein, 9 aa, Human coronavirus
SRGFRFRRR

SEQ ID NO: 94 - protein, 5 aa, Human coronavirus
IRVHF

SEQ ID NO: 95 - protein, 7 aa, Human coronavirus
RRVGCCS

SEQ ID NO: 96 - protein, 5 aa, Human coronavirus
SVPSR

SEQ ID NO: 97 - protein, 5 aa, Human coronavirus
SRRCY

SEQ ID NO: 98 - protein, 13 aa, Human coronavirus
ICARRSTTSRSTC

SEQ ID NO: 99 - protein, 8 aa, Human coronavirus
RYCAGCHS

SEQ ID NO: 100 - protein, 9 aa, Human coronavirus
HLTGNSCCA

SEQ ID NO: 101 - protein, 26 aa, Human coronavirus
SPTASGETSVCTSDYPARGKRSCTCL

SEQ ID NO: 102 - protein, 9 aa, Human coronavirus
YRTDTECYC

SEQ ID NO: 103 - protein, 6 aa, Human coronavirus
EVTQKA

SEQ ID NO: 104 - protein, 5 aa, Human coronavirus
PFVQF

SEQ ID NO: 105 - protein, 11 aa, Human coronavirus
GYYRVRYHSFR

SEQ ID NO: 106 - protein, 14 aa, Human coronavirus
RNSSSQVLWGVCVS

SEQ ID NO: 107 - protein, 9 aa, Human coronavirus
AWRWYRWCY

SEQ ID NO: 108 - protein, 12 aa, Human coronavirus
CGFKRGCPKRVR

SEQ ID NO: 109 - protein, 4 aa, Human coronavirus
VYSG

SEQ ID NO: 110 - protein, 17 aa, Human coronavirus
RAVTSRRFSSLARPFSS

SEQ ID NO: 111 - protein, 12 aa, Human coronavirus
EYPACRRPRCPR

SEQ ID NO: 112 - protein, 6 aa, Human coronavirus
TGCFSP

SEQ ID NO: 113 - protein, 26 aa, Human coronavirus
GYECISSCSHSSCFSRHIWCKTSCVF

SEQ ID NO: 114 - protein, 5 aa, Human coronavirus
SFSRR

SEQ ID NO: 115 - protein, 5 aa, Human coronavirus
FPRCL

SEQ ID NO: 116 - protein, 5 aa, Human coronavirus
ESYHS

SEQ ID NO: 117 - protein, 9 aa, Human coronavirus
HSTEFDFFI

SEQ ID NO: 118 - protein, 7 aa, Human coronavirus
WVTWRNT

SEQ ID NO: 119 - protein, 14 aa, Human coronavirus
RLWFYCFCVHRQLC

SEQ ID NO: 120 - protein, 4 aa, Human coronavirus
EQGC

SEQ ID NO: 121 - protein, 5 aa, Human coronavirus
EVSYS

SEQ ID NO: 122 - protein, 9 aa, Human coronavirus
RCAILLLHV

SEQ ID NO: 123 - protein, 4 aa, Human coronavirus
GHFR

SEQ ID NO: 124 - protein, 5 aa, Human coronavirus
YLTTG

SEQ ID NO: 125 - protein, 26 aa, Human coronavirus
VCWYYIYAFGICVSWFRLNASRECRA

SEQ ID NO: 126 - protein, 8 aa, Human coronavirus
RALRVSPS

SEQ ID NO: 127 - protein, 8 aa, Human coronavirus
RARSYFDV

SEQ ID NO: 128 - protein, 13 aa, Human coronavirus
VKPFRRFYKARPH

SEQ ID NO: 129 - protein, 11 aa, Human coronavirus
WWLQFLAFSRG

SEQ ID NO: 130 - protein, 9 aa, Human coronavirus
TIGARLTLK

SEQ ID NO: 131 - protein, 5 aa, Human coronavirus
APALV

SEQ ID NO: 132 - protein, 7 aa, Human coronavirus
SNHMLQG

SEQ ID NO: 133 - protein, 7 aa, Human coronavirus
CVLCCKE

SEQ ID NO: 134 - protein, 5 aa, Human coronavirus
YSFSI

SEQ ID NO: 135 - protein, 30 aa, Human coronavirus
NTFSMSCVFGFTHDTAVNNRSLSDCRWCKF

SEQ ID NO: 136 - protein, 5 aa, Human coronavirus
NSRSK

SEQ ID NO: 137 - protein, 8 aa, Human coronavirus
ITAWMRFL

SEQ ID NO: 138 - protein, 15 aa, Human coronavirus
ETEWSQFISSRQFDC

SEQ ID NO: 139 - protein, 4 aa, Human coronavirus
NKGA

SEQ ID NO: 140 - protein, 6 aa, Human coronavirus
RVIWPR

SEQ ID NO: 141 - protein, 10 aa, Human coronavirus
SYFLTQILFT

SEQ ID NO: 142 - protein, 11 aa, Human coronavirus
GCSPWVEDGCV

SEQ ID NO: 143 - protein, 7 aa, Human coronavirus
GTFSQIE

SEQ ID NO: 144 - protein, 6 aa, Human coronavirus
CSYYDT

SEQ ID NO: 145 - protein, 5 aa, Human coronavirus
FIEGH

SEQ ID NO: 146 - protein, 13 aa, Human coronavirus
ICYTCSTACIYET

SEQ ID NO: 147 - protein, 17 aa, Human coronavirus
LHSPHYGLWQLHIWCSR

SEQ ID NO: 148 - protein, 12 aa, Human coronavirus
CLSVTSYRACKG

SEQ ID NO: 149 - protein, 37 aa, Human coronavirus
VMLFCTHGLERVVQCLWHKRCCSTRLKSLLLRGCANC

SEQ ID NO: 150 - protein, 14 aa, Human coronavirus
RSACSHDICMPVWW

SEQ ID NO: 151 - protein, 20 aa, Human coronavirus
TSSAISRTHHPLVAALRHTK

SEQ ID NO: 152 - protein, 9 aa, Human coronavirus
KIGDNLHGA

SEQ ID NO: 153 - protein, 4 aa, Human coronavirus
FCSI

SEQ ID NO: 154 - protein, 5 aa, Human coronavirus
CLSGH

SEQ ID NO: 155 - protein, 19 aa, Human coronavirus
NGCWPLCSCSPEGWSYFKV

SEQ ID NO: 156 - protein, 4 aa, Human coronavirus
LWHR

SEQ ID NO: 157 - protein, 20 aa, Human coronavirus
QDFRLEVQGDRCTFPRPKIQ

SEQ ID NO: 158 - protein, 8 aa, Human coronavirus
CRTVFFGR

SEQ ID NO: 159 - protein, 5 aa, Human coronavirus
FQNRG

SEQ ID NO: 160 - protein, 8 aa, Human coronavirus
SRPICFLC

SEQ ID NO: 161 - protein, 4 aa, Human coronavirus
ILYK

SEQ ID NO: 162 - protein, 13 aa, Human coronavirus
TTRNIFTSYNFSW

SEQ ID NO: 163 - protein, 5 aa, Human coronavirus
LPCIV

SEQ ID NO: 164 - protein, 5 aa, Human coronavirus
WTTWR

SEQ ID NO: 165 - protein, 4 aa, Human coronavirus
PFRV

SEQ ID NO: 166 - protein, 8 aa, Human coronavirus
EIHLLLLA

SEQ ID NO: 167 - protein, 8 aa, Human coronavirus
RRRRCVVG

SEQ ID NO: 168 - protein, 5 aa, Human coronavirus
EWCHV

SEQ ID NO: 169 - protein, 8 aa, Human coronavirus
RQTNSLGQ

SEQ ID NO: 170 - protein, 5 aa, Human coronavirus
FASNF

SEQ ID NO: 171 - protein, 4 aa, Human coronavirus
RSPH

SEQ ID NO: 172 - protein, 11 aa, Human coronavirus
IHTFECGVYTS

SEQ ID NO: 173 - protein, 18 aa, Human coronavirus
TSNCRCGSTSTGNDNCQM

SEQ ID NO: 174 - protein, 11 aa, Human coronavirus
TFREGQCQFRC

SEQ ID NO: 175 - protein, 6 aa, Human coronavirus
FRYSRC

SEQ ID NO: 176 - protein, 10 aa, Human coronavirus
RRPTYIVCRP

SEQ ID NO: 177 - protein, 15 aa, Human coronavirus
VSSHCLKRQCTFFYA

SEQ ID NO: 178 - protein, 4 aa, Human coronavirus
IAHR

SEQ ID NO: 179 - protein, 10 aa, Human coronavirus
RCCSFRIFDT

SEQ ID NO: 180 - protein, 5 aa, Human coronavirus
SEVTI

SEQ ID NO: 181 - protein, 20 aa, Human coronavirus
GFILFQRICYPHFHCYHCCR

SEQ ID NO: 182 - protein, 12 aa, Human coronavirus
LYKECSAASRCY

SEQ ID NO: 183 - protein, 7 aa, Human coronavirus
RHIDRLF

SEQ ID NO: 184 - protein, 13 aa, Human coronavirus
FCQDVIYASTSLL

SEQ ID NO: 185 - protein, 8 aa, Human coronavirus
FKTRHHRG

SEQ ID NO: 186 - protein, 12 aa, Human coronavirus
SECFENSRRCDR

SEQ ID NO: 187 - protein, 10 aa, Human coronavirus
CCKTVLHCCC

SEQ ID NO: 188 - protein, 4 aa, Human coronavirus
FKYG

SEQ ID NO: 189 - protein, 38 aa, Human coronavirus
VAPCGLEINPTVVTYVMHNYGIVVFCVSLVCLQSGLIK

SEQ ID NO: 190 - protein, 12 aa, Human coronavirus
RCPRFEKVLQRS

SEQ ID NO: 191 - protein, 9 aa, Human coronavirus
SLPRNLFCL

SEQ ID NO: 192 - protein, 6 aa, Human coronavirus
RSCFSL

SEQ ID NO: 193 - protein, 4 aa, Human coronavirus
GEFL

SEQ ID NO: 194 - protein, 12 aa, Human coronavirus
CTYILRKPFCNV

SEQ ID NO: 195 - protein, 4 aa, Human coronavirus
LVLD

SEQ ID NO: 196 - protein, 10 aa, Human coronavirus
PRFHNSLPSS

SEQ ID NO: 197 - protein, 6 aa, Human coronavirus
DGSNTS

SEQ ID NO: 198 - protein, 4 aa, Human coronavirus
PLCS

SEQ ID NO: 199 - protein, 8 aa, Human coronavirus
HRLVVVCI

SEQ ID NO: 200 - protein, 42 aa, Human coronavirus
DWFGIHALYLGLQLVVVGRYIALFLCTDFHICRLAVIQLCCV

SEQ ID NO: 201 - protein, 17 aa, Human coronavirus
CLLVIHPHSNGGFGTNV

SEQ ID NO: 202 - protein, 28 aa, Human coronavirus
FVSMPLAFTQVLSACNQWLQRYGMLALL

SEQ ID NO: 203 - protein, 5 aa, Human coronavirus
EEPTY

SEQ ID NO: 204 - protein, 24 aa, Human coronavirus
SFYRCLWWKTYVLYHSKWRYFILS

SEQ ID NO: 205 - protein, 6 aa, Human coronavirus
LELCGL

SEQ ID NO: 206 - protein, 10 aa, Human coronavirus
HCRCGEYLHL

SEQ ID NO: 207 - protein, 4 aa, Human coronavirus
RSRK

SEQ ID NO: 208 - protein, 9 aa, Human coronavirus
PHYRPTQAY

SEQ ID NO: 209 - protein, 10 aa, Human coronavirus
ITLLCGFRYS

SEQ ID NO: 210 - protein, 6 aa, Human coronavirus
RDCCSV

SEQ ID NO: 211 - protein, 18 aa, Human coronavirus
RRSTILRAVSPLRFYKSR

SEQ ID NO: 212 - protein, 7 aa, Human coronavirus
VEVQRGL

SEQ ID NO: 213 - protein, 6 aa, Human coronavirus
NYYWYT

SEQ ID NO: 214 - protein, 17 aa, Human coronavirus
IQLYHLRLIRSWPGKFS

SEQ ID NO: 215 - protein, 11 aa, Human coronavirus
VCMCLLFSSLV

SEQ ID NO: 216 - protein, 5 aa, Human coronavirus
INSFG

SEQ ID NO: 217 - protein, 8 aa, Human coronavirus
LKFGYFCW

SEQ ID NO: 218 - protein, 5 aa, Human coronavirus
FRLAV

SEQ ID NO: 219 - protein, 4 aa, Human coronavirus
CHTR

SEQ ID NO: 220 - protein, 9 aa, Human coronavirus
VGKTYLYCS

SEQ ID NO: 221 - protein, 6 aa, Human coronavirus
WRKARR

SEQ ID NO: 222 - protein, 6 aa, Human coronavirus
CLNNIH

SEQ ID NO: 223 - protein, 10 aa, Human coronavirus
RSTRPRRCGV

SEQ ID NO: 224 - protein, 6 aa, Human coronavirus
LCAVCS

SEQ ID NO: 225 - protein, 4 aa, Human coronavirus
HTNY

SEQ ID NO: 226 - protein, 6 aa, Human coronavirus
LCTLIC

SEQ ID NO: 227 - protein, 7 aa, Human coronavirus
CVYQRFR

SEQ ID NO: 228 - protein, 4 aa, Human coronavirus
CGFS

SEQ ID NO: 229 - protein, 5 aa, Human coronavirus
PNCLA

SEQ ID NO: 230 - protein, 17 aa, Human coronavirus
WCLHLERCCIYETLGCT

SEQ ID NO: 231 - protein, 8 aa, Human coronavirus
TTDSHCMP

SEQ ID NO: 232 - protein, 12 aa, Human coronavirus
FSFPVNHLKATR

SEQ ID NO: 233 - protein, 4 aa, Human coronavirus
YLIS

SEQ ID NO: 234 - protein, 10 aa, Human coronavirus
QNCWWCSYMV

SEQ ID NO: 235 - protein, 32 aa, Human coronavirus
LYVKGLCSCYHYCVSVCCTDVFVFTYIFYGTC

SEQ ID NO: 236 - protein, 6 aa, Human coronavirus
RPHLGL

SEQ ID NO: 237 - protein, 4 aa, Human coronavirus
GCKS

SEQ ID NO: 238 - protein, 9 aa, Human coronavirus
APVLHTMVS

SEQ ID NO: 239 - protein, 6 aa, Human coronavirus
ACWWCL

SEQ ID NO: 240 - protein, 43 aa, Human coronavirus
QLYHMPIDSCSNCWSCWCSHSRRTYYIGLGEQSDNFLCFSSLC

SEQ ID NO: 241 - protein, 10 aa, Human coronavirus
YRQCLLHSYR

SEQ ID NO: 242 - protein, 6 aa, Human coronavirus
WLHSSI

SEQ ID NO: 243 - protein, 4 aa, Human coronavirus
VHYV

SEQ ID NO: 244 - protein, 11 aa, Human coronavirus
GCRGPYDTILP

SEQ ID NO: 245 - protein, 22 aa, Human coronavirus
SYCFAWGFCVQSDEASCSLRLV

SEQ ID NO: 246 - protein, 10 aa, Human coronavirus
NSVNSVLPVR

SEQ ID NO: 247 - protein, 17 aa, Human coronavirus
VCTRGCLYYHKWLVGHF

SEQ ID NO: 248 - protein, 7 aa, Human coronavirus
TWCLLWL

SEQ ID NO: 249 - protein, 39 aa, Human coronavirus
HCQAVSSITVPAYYLFPIDYLIGLGYRFVCVPDFALLLY

SEQ ID NO: 250 - protein, 21 aa, Human coronavirus
SKTCFCRLHPVCCNCCCCCCS

SEQ ID NO: 251 - protein, 28 aa, Human coronavirus
LVHLLCYLYTIVYSTLHCIVLLCYILFY

SEQ ID NO: 252 - protein, 31 aa, Human coronavirus
ACIYYACFLVHYVRAYRSHMDDLRLYSCNVL

SEQ ID NO: 253 - protein, 9 aa, Human coronavirus
TLLLGFSLF

SEQ ID NO: 254 - protein, 7 aa, Human coronavirus
ETCRSFY

SEQ ID NO: 255 - protein, 6 aa, Human coronavirus
FPGRCL

SEQ ID NO: 256 - protein, 4 aa, Human coronavirus
YLCY

SEQ ID NO: 257 - protein, 7 aa, Human coronavirus
QGHLCSS

SEQ ID NO: 258 - protein, 4 aa, Human coronavirus
KLFN

SEQ ID NO: 259 - protein, 9 aa, Human coronavirus
CLFTIFGVV

SEQ ID NO: 260 - protein, 12 aa, Human coronavirus
VLLWCYGNSRLS

SEQ ID NO: 261 - protein, 7 aa, Human coronavirus
SCSMSSC

SEQ ID NO: 262 - protein, 9 aa, Human coronavirus
SLTNIQRDW

SEQ ID NO: 263 - protein, 8 aa, Human coronavirus
SSLPTTQL

SEQ ID NO: 264 - protein, 20 aa, Human coronavirus
HNLWRVAKRFGENVTSQWRC

SEQ ID NO: 265 - protein, 9 aa, Human coronavirus
GLYGSGYLR

SEQ ID NO: 266 - protein, 4 aa, Human coronavirus
WSLA

SEQ ID NO: 267 - protein, 13 aa, Human coronavirus
QHSLVPTTRNVPG

SEQ ID NO: 268 - protein, 7 aa, Human coronavirus
CLVDFYD

SEQ ID NO: 269 - protein, 32 aa, Human coronavirus
FQCAKTHWRSSKLACCWSCHARHSFEVDCRCC

SEQ ID NO: 270 - protein, 15 aa, Human coronavirus
HSSLHFYNSETWRSI

SEQ ID NO: 271 - protein, 5 aa, Human coronavirus
CVSML

SEQ ID NO: 272 - protein, 13 aa, Human coronavirus
WSSDWYIHCCNAP

SEQ ID NO: 273 - protein, 9 aa, Human coronavirus
GFLSVWFLW

SEQ ID NO: 274 - protein, 7 aa, Human coronavirus
CWLHQGG

SEQ ID NO: 275 - protein, 13 aa, Human coronavirus
CDQFLLHASNGTC

SEQ ID NO: 276 - protein, 8 aa, Human coronavirus
WYTYRFSI

SEQ ID NO: 277 - protein, 9 aa, Human coronavirus
WYYVWCLYG

SEQ ID NO: 278 - protein, 14 aa, Human coronavirus
TSAPSSVNRQILQC

SEQ ID NO: 279 - protein, 10 aa, Human coronavirus
CSSLALRSNT

SEQ ID NO: 280 - protein, 8 aa, Human coronavirus
WLRLVCKT

SEQ ID NO: 281 - protein, 4 aa, Human coronavirus
CCFF

SEQ ID NO: 282 - protein, 8 aa, Human coronavirus
MGSCQPIH

SEQ ID NO: 283 - protein, 7 aa, Human coronavirus
ICWHSIR

SEQ ID NO: 284 - protein, 10 aa, Human coronavirus
HVSCQNRRCY

SEQ ID NO: 285 - protein, 26 aa, Human coronavirus
TAALCDPTTVYWVPGKANPWQYHVGR

SEQ ID NO: 286 - protein, 38 aa, Human coronavirus
YADYGCGYAEWCEKSYIWYCALVVCDPCLNLCDNLTSH

SEQ ID NO: 287 - protein, 8 aa, Human coronavirus
IYFVELLV

SEQ ID NO: 288 - protein, 21 aa, Human coronavirus
DYSHTVVPTLICDYGLRYVVG

SEQ ID NO: 289 - protein, 44 aa, Human coronavirus
TQTHLFDTFLVACGYLFDLCKHSLRAHYSHFVSADCSCKLACPH

SEQ ID NO: 290 - protein, 8 aa, Human coronavirus
CLYAHYTY

SEQ ID NO: 291 - protein, 5 aa, Human coronavirus
YWCLH

SEQ ID NO: 292 - protein, 18 aa, Human coronavirus
YVTCISHCSEEIVQPITF

SEQ ID NO: 293 - protein, 15 aa, Human coronavirus
LCVSIVQWCNVVVHL

SEQ ID NO: 294 - protein, 18 aa, Human coronavirus
HWRSLKPHCLSGFCHYTH

SEQ ID NO: 295 - protein, 59 aa, Human coronavirus
LYDYSLCYCQPCKSLHLCHLCLLTTAYTCVSGSEDDTFIIHMFRFHVYLLFWCLLSFEP

SEQ ID NO: 296 - protein, 6 aa, Human coronavirus
STYGCL

SEQ ID NO: 297 - protein, 11 aa, Human coronavirus
GLNTRVQIHDC

SEQ ID NO: 298 - protein, 5 aa, Human coronavirus
QSNCT

SEQ ID NO: 299 - protein, 10 aa, Human coronavirus
KFLGGYGSEL

SEQ ID NO: 300 - protein, 17 aa, Human coronavirus
VNRYWRYTLYKGCCYAV

SEQ ID NO: 301 - protein, 4 aa, Human coronavirus
TYRS

SEQ ID NO: 302 - protein, 17 aa, Human coronavirus
MHICGSPLCAPTVTLRG

SEQ ID NO: 303 - protein, 6 aa, Human coronavirus
GLGFLC

SEQ ID NO: 304 - protein, 8 aa, Human coronavirus
YIGSNRPQ

SEQ ID NO: 305 - protein, 17 aa, Human coronavirus
GFREIRKSLCYFNDFFW

SEQ ID NO: 306 - protein, 7 aa, Human coronavirus
RTSSYSF

SEQ ID NO: 307 - protein, 8 aa, Human coronavirus
VFTLSYLC

SEQ ID NO: 308 - protein, 15 aa, Human coronavirus
VGSCAESLSGSYGLW

SEQ ID NO: 309 - protein, 6 aa, Human coronavirus
HLTTSS

SEQ ID NO: 310 - protein, 6 aa, Human coronavirus
GFAEGC

SEQ ID NO: 311 - protein, 4 aa, Human coronavirus
GSGP

SEQ ID NO: 312 - protein, 5 aa, Human coronavirus
VRTYG

SEQ ID NO: 313 - protein, 7 aa, Human coronavirus
SGYDFYV

SEQ ID NO: 314 - protein, 4 aa, Human coronavirus
ASTC

SEQ ID NO: 315 - protein, 18 aa, Human coronavirus
RQESKNCQCYANYVVWYD

SEQ ID NO: 316 - protein, 7 aa, Human coronavirus
EARQRCS

SEQ ID NO: 317 - protein, 4 aa, Human coronavirus
WYHF

SEQ ID NO: 318 - protein, 6 aa, Human coronavirus
EWLYTS

SEQ ID NO: 319 - protein, 8 aa, Human coronavirus
CHPTVCFK

SEQ ID NO: 320 - protein, 6 aa, Human coronavirus
TSRCNS

SEQ ID NO: 321 - protein, 13 aa, Human coronavirus
LHRLESGSHISLA

SEQ ID NO: 322 - protein, 16 aa, Human coronavirus
LRWGFVGHYSYKQCGQ

SEQ ID NO: 323 - protein, 8 aa, Human coronavirus
VFRCCRQQ

SEQ ID NO: 324 - protein, 11 aa, Human coronavirus
KFNMATCFRMH

SEQ ID NO: 325 - protein, 6 aa, Human coronavirus
GIHFCR

SEQ ID NO: 326 - protein, 18 aa, Human coronavirus
DQTFRSKNHGCVCGSRAN

SEQ ID NO: 327 - protein, 11 aa, Human coronavirus
FLSLLRTCAGS

SEQ ID NO: 328 - protein, 7 aa, Human coronavirus
NADGSSF

SEQ ID NO: 329 - protein, 8 aa, Human coronavirus
CLSQMGAC

SEQ ID NO: 330 - protein, 22 aa, Human coronavirus
GRICQCRATTSLQILDCGTKRT

SEQ ID NO: 331 - protein, 7 aa, Human coronavirus
NPISLFC

SEQ ID NO: 332 - protein, 15 aa, Human coronavirus
QPSSRASVRAHCCDC

SEQ ID NO: 333 - protein, 5 aa, Human coronavirus
IASWF

SEQ ID NO: 334 - protein, 5 aa, Human coronavirus
HRVCL

SEQ ID NO: 335 - protein, 7 aa, Human coronavirus
FLGVVTC

SEQ ID NO: 336 - protein, 20 aa, Human coronavirus
SSKSLSRFRQCGRCPIDKLC

SEQ ID NO: 337 - protein, 4 aa, Human coronavirus
DAYS

SEQ ID NO: 338 - protein, 9 aa, Human coronavirus
NWYRYSYIC

SEQ ID NO: 339 - protein, 5 aa, Human coronavirus
TREYS

SEQ ID NO: 340 - protein, 20 aa, Human coronavirus
SRDLWWSFSVSLLPCAYRTS

SEQ ID NO: 341 - protein, 5 aa, Human coronavirus
CLWCL

SEQ ID NO: 342 - protein, 10 aa, Human coronavirus
VCPNPCSVCP

SEQ ID NO: 343 - protein, 11 aa, Human coronavirus
PCGILFVKYPL

SEQ ID NO: 344 - protein, 12 aa, Human coronavirus
CLSILDWIWVQL

SEQ ID NO: 345 - protein, 7 aa, Human coronavirus
ASSTAPI

SEQ ID NO: 346 - protein, 2699 aa, Human coronavirus
RFQFFKRVRGSIVNARIEPCSSGLSTDVVFRAFDICNYKAKVAGIGKYYKTNTCRFVELDDQGHHLDSYFVVKRHTMENYELEKHCYDLLRDCDAVAPHDFFIFDVDKVKTPHIVRQRLTEYTMMDLVYALRHFDQNSEVLKAILVKYGCCDVTYFENKLWFDFVENPSVIGVYHKLGERVRQAILNTVKFCDHMVKAGLVGVLTLDNQDLNGKWYDFGDFVITQPGSGVAIVDSYYSYLMPVLSMTDCLAAETHRDCDFNKPLIEWPLTEYDFTDYKVQLFEKYFKYWDQTYHANCVNCTDDRCVLHCANFNVLFAMTMPKTCFGPIVRKIFVDGVPFVVSCGYHYKELGLVMNMDVSLHRHRLSLKELMMYAADPAMHIASSNAFLDLRTSCFSVAALTTGLTFQTVRPGNFNQDFYDFVVSKGFFKEGSSVTLKHFFFAQDGNAAITDYNYYSYNLPTMCDIKQMLFCMEVVNKYFEIYDGGCLNASEVVVNNLDKSAGHPFNKFGKARVYYESMSYQEQDELFAMTKRNVIPTMTQMNLKYAISAKNRARTVAGVSILSTMTNRQYHQKMLKSMAATRGATCVIGTTKFYGGWDFMLKTLYKDVDNPHLMGWDYPKCDRAMPNMCRIFASLILARKHGTCCTTRDRFYRLANECAQVLSEYVLCGGGYYVKPGGTSSGDATTAYANSVFNILQATTANVSALMGANGNKIVDKEVKDMQFDLYVNVYRSTSPDPKFVDKYYAFLNKHFSMMILSDDGVVCYNSDYAAKGYIAGIQNFKETLYYQNNVFMSEAKCWVETDLKKGPHEFCSQHTLYIKDGDDGYFLPYPDPSRILSAGCFVDDIVKTDGTLMVERFVSLAIDAYPLTKHEDIEYQNVFWVYLQYIEKLYKDLTGHMLDSYSVMLCGDNSAKFWEEAFYRDLYSSPTTLQAVGSCVVCHSQTSLRCGTCIRRPFLCCKCCYDHVIATPHKMVLSVSPYVCNAPGCGVSDVTKLYLGGMSYFCVDHRPVCSFPLCANGLVFGLYKNMCTGSPSIVEFNRLATCDWTESGDYTLANTTTEPLKLFAAETLRATEEASKQSYAIATIKEIVGERQLLLVWEAGKSKPPLNRNYVFTGYHITKNSKVQLGEYIFERIDYSDAVSYKSSTTYKLTVGDIFVLTSHSVATLTAPTIVNQERYVKITGLYPTITVPEEFASHVANFQKSGYSKYVTVQGPPGTGKSHFAIGLAIYYPTARVVYTACSHAAVDALCEKAFKYLNIAKCSRIIPAKARVECYDRFKVNETNSQYLFSTINALPETSADILVVDEVSMCTNYDLSIINARIKAKHIVYVGDPAQLPAPRTLLTRGTLEPENFNSVTRLMCNLGPDIFLSMCYRCPKEIVSTVSALVYNNKLLAKKELSGQCFKILYKGNVTHDASSAINRPQLTFVKNFITANPAWSKAVFISPYNSQNAVSRSMLGLTTQTVDSSQGSEYQYVIFCQTADTAHANNINRFNVAITRAQKGILCVMTSQALFESLEFTELSFTNYKLQSQIVTGLFKDCSRETSGLSPAYAPTYVSVDDKYKTSDELCVNLNLPANVPYSRVISRMGFKLDATVPGYPKLFITREEAVRQVRSWIGFDVEGAHASRNACGTNVPLQLGFSTGVNFVVQPVGVVDTEWGNMLTGIAARPPPGEQFKHLVPLMHKGAAWPIVRRRIVQMLSDTLDKLSDYCTFVCWAHGFELTSASYFCKIGKEQKCCMCNRRAAAYSSPLQSYACWTHSCGYDYVYNPFFVDVQQWGYVGNLATNHDRYCSVHQGAHVASNDAIMTRCLAIHSCFIERVDWDIEYPYISHEKKLNSCCRIVERNVVRAALLAGSFDKVYDIGNPKGIPIVDDPVVDWHYFDAQPLTRKVQQLFYTEDMASRFADGLCLFWNCNVPKYPNNAIVCRFDTRVHSEFNLPGCDGGSLYVNKHAFHTPAYDVSAFRDLKPLPFFYYSTTPCEVHGNGSMIEDIDYVPLKSAVCITACNLGGAVCRKHATEYREYMEAYNLVSASGFRLWCYKTFDIYNLWSTFTKVQGLENIAFNVVKQGHFIGVEGELPVAVVNDKIFTKSGVNDICMFENKTTLPTNIAFELYAKRAVRSHPDFKLLHNLQADICYKFVLWDYERSNIYGTATIGVCKYTDIDVNSALNICFDIRDNCSLEKFMSTPNAIFISDRKIKKYPCMVGPDYAYFNGAIIRDSDVVKQPVKFYLYKKVNNEFIDPTECIYTQSRSCSDFLPLSDMEKDFLSFDSDVFIKKYGLENYAFEHVVYGDFSHTTLGGLHLLIGLYKKQQEGHIIMEEMLKGSSTIHNYFITETNTAAFKAVCSVIDLKLDDFVMILKSQDLGVVSKVVKVPIDLTMIEFMLWCKDGQVQTFYPRLQASADWKPGHAMPSLFKVQNVNLERCELANYKQSIPMPRGVHMNIAKYMQLCQYLNTCTLAVPANMRVIHFGAGSDKGIAPGTSVLRQWLPTDAIIIDNDLNEFVSDADITLFGDCVTVRVGQQVDLVISDMYDPTTKNVTGSNESKALFFTYLCNLINNNLALGGSVAIKITEHSWSVELYELMGKFAWWTVFCTNANASSSEGFLLGINYLGTIKENIDGGAMHANYIFWRNSTPMNLSTYSLFDLSKFQLKLKGTPVLQLKESQINELVISLLSQGKLLIRDNDTLSVSTDVLVNTYRKLR

SEQ ID NO: 347 - protein, 6 aa, Human coronavirus
CRARFC

SEQ ID NO: 348 - protein, 4 aa, Human coronavirus
VCLY

SEQ ID NO: 349 - protein, 6 aa, Human coronavirus
YTTDFL

SEQ ID NO: 350 - protein, 11 aa, Human coronavirus
RYYIPSRPYIF

SEQ ID NO: 351 - protein, 16 aa, Human coronavirus
HNYHLSRSFSLSGRPW

SEQ ID NO: 352 - protein, 20 aa, Human coronavirus
YVCLLCRTCYRHNSTKVVCS

SEQ ID NO: 353 - protein, 9 aa, Human coronavirus
LFSGRQTVC

SEQ ID NO: 354 - protein, 18 aa, Human coronavirus
WVCRPYRSSCQFHWHCYY

SEQ ID NO: 355 - protein, 21 aa, Human coronavirus
PIYQRYYTKNLPCFYAGFFSW

SEQ ID NO: 356 - protein, 4 aa, Human coronavirus
FLRW

SEQ ID NO: 357 - protein, 20 aa, Human coronavirus
NGPLLQSYSSSFARWMWHFT

SEQ ID NO: 358 - protein, 34 aa, Human coronavirus
SFLLYSRASLWKSLSCWQFLYFFCHLSHSCNRLF

SEQ ID NO: 359 - protein, 5 aa, Human coronavirus
WQLQS

SEQ ID NO: 360 - protein, 6 aa, Human coronavirus
CQSELF

SEQ ID NO: 361 - protein, 7 aa, Human coronavirus
LHLYVHL

SEQ ID NO: 362 - protein, 4 aa, Human coronavirus
HYRR

SEQ ID NO: 363 - protein, 22 aa, Human coronavirus
DFRVVWHYTNCSRCSPLLISVC

SEQ ID NO: 364 - protein, 15 aa, Human coronavirus
FVRRQYVSICHLACL

SEQ ID NO: 365 - protein, 14 aa, Human coronavirus
VLFYHSSQYSFYPK

SEQ ID NO: 366 - protein, 9 aa, Human coronavirus
KSLGCLLRI

SEQ ID NO: 367 - protein, 12 aa, Human coronavirus
TSTVNFPVGFFC

SEQ ID NO: 368 - protein, 11 aa, Human coronavirus
WLYTQSYRLWF

SEQ ID NO: 369 - protein, 8 aa, Human coronavirus
FVTTPLLI

SEQ ID NO: 370 - protein, 4 aa, Human coronavirus
ILRC

SEQ ID NO: 371 - protein, 21 aa, Human coronavirus
IWSLFSFVFRSKTFWLSCGTG

SEQ ID NO: 372 - protein, 13 aa, Human coronavirus
FFTSSVWHTSSGL

SEQ ID NO: 373 - protein, 11 aa, Human coronavirus
FQAFGFYQLQL

SEQ ID NO: 374 - protein, 11 aa, Human coronavirus
SYQIAFTFFCE

SEQ ID NO: 375 - protein, 8 aa, Human coronavirus
SNISSSNC

SEQ ID NO: 376 - protein, 15 aa, Human coronavirus
QLLFFTDFGLLFIPT

SEQ ID NO: 377 - protein, 7 aa, Human coronavirus
YEIRSQC

SEQ ID NO: 378 - protein, 8 aa, Human coronavirus
FCWSNIPV

SEQ ID NO: 379 - protein, 4 aa, Human coronavirus
TVLF

SEQ ID NO: 380 - protein, 11 aa, Human coronavirus
SHMFDFSDCSS

SEQ ID NO: 381 - protein, 5 aa, Human coronavirus
PYYYY

SEQ ID NO: 382 - protein, 4 aa, Human coronavirus
VQLY

SEQ ID NO: 383 - protein, 7 aa, Human coronavirus
QVLSSSF

SEQ ID NO: 384 - protein, 7 aa, Human coronavirus
STSVSER

SEQ ID NO: 385 - protein, 17 aa, Human coronavirus
SILTLCIHCPIHCVGRR

SEQ ID NO: 386 - protein, 6 aa, Human coronavirus
ETTIST

SEQ ID NO: 387 - protein, 7 aa, Human coronavirus
RWWLACC

SEQ ID NO: 388 - protein, 7 aa, Human coronavirus
WLNCCHD

SEQ ID NO: 389 - protein, 17 aa, Human coronavirus
AITDGLWYYSSIWYRHQ

SEQ ID NO: 390 - protein, 5 aa, Human coronavirus
CLPQA

SEQ ID NO: 391 - protein, 39 aa, Human coronavirus
HKNCLSIRQLRGIFPLWCFGPWCFSELHSCRCSTAALCL

SEQ ID NO: 392 - protein, 10 aa, Human coronavirus
CVPEFSWLLF

SEQ ID NO: 393 - protein, 10 aa, Human coronavirus
WQLLLFACLC

SEQ ID NO: 394 - protein, 7 aa, Human coronavirus
CSCFCHL

SEQ ID NO: 395 - protein, 7 aa, Human coronavirus
NPRYSIW

SEQ ID NO: 396 - protein, 17 aa, Human coronavirus
THFFYHVSILPFYAINA

SEQ ID NO: 397 - protein, 20 aa, Human coronavirus
TARFYIWPPSDTCWLCPRTC

SEQ ID NO: 398 - protein, 20 aa, Human coronavirus
FLFVRRGLQVASWSISLCSS

SEQ ID NO: 399 - protein, 12 aa, Human coronavirus
YSHTSQCALCSR

SEQ ID NO: 400 - protein, 8 aa, Human coronavirus
NALGIHCF

SEQ ID NO: 401 - protein, 5 aa, Human coronavirus
SSYSG

SEQ ID NO: 402 - protein, 5 aa, Human coronavirus
IKYTH

SEQ ID NO: 403 - protein, 19 aa, Human coronavirus
FFLWCDSGVHSDNHSESYC

SEQ ID NO: 404 - protein, 10 aa, Human coronavirus
TVRLQWFPEV

SEQ ID NO: 405 - protein, 25 aa, Human coronavirus
AITARVWPVLFQNKPGSPWCQFTPG

SEQ ID NO: 406 - protein, 19 aa, Human coronavirus
FVCEREKLSIISYHTRFWR

SEQ ID NO: 407 - protein, 14 aa, Human coronavirus
FDTSRTCFYIYWQS

SEQ ID NO: 408 - protein, 4 aa, Human coronavirus
GFAI

SEQ ID NO: 409 - protein, 5 aa, Human coronavirus
QSHYS

SEQ ID NO: 410 - protein, 8 aa, Human coronavirus
SWLYARLR

SEQ ID NO: 411 - protein, 10 aa, Human coronavirus
LHAARSSISS

SEQ ID NO: 412 - protein, 19 aa, Human coronavirus
SYLCSICGWLQSITSSYGC

SEQ ID NO: 413 - protein, 36 aa, Human coronavirus
YGSRVYFIFAWQHSRCWLDCWLILLCCYSICTEYLL

SEQ ID NO: 414 - protein, 20 aa, Human coronavirus
VKRCWHYSTGSFREPKAYCQ

SEQ ID NO: 415 - protein, 13 aa, Human coronavirus
SGSGSYANRLHYN

SEQ ID NO: 416 - protein, 20 aa, Human coronavirus
SFSEGSGCCEQQCTGSIQIS

SEQ ID NO: 417 - protein, 16 aa, Human coronavirus
YFWCYFRLYWRHHTTS

SEQ ID NO: 418 - protein, 12 aa, Human coronavirus
CSRTGRPNRQTY

SEQ ID NO: 419 - protein, 27 aa, Human coronavirus
WPFDNTKCFCCTAACSFRISCSFRSIG

SEQ ID NO: 420 - protein, 26 aa, Human coronavirus
VCQGTIQAFWILRSRHTYSVLCCKCP

SEQ ID NO: 421 - protein, 11 aa, Human coronavirus
WPLLHACWLLP

SEQ ID NO: 422 - protein, 11 aa, Human coronavirus
GCFCLWSLRCS

SEQ ID NO: 423 - protein, 5 aa, Human coronavirus
LYSPC

SEQ ID NO: 424 - protein, 4 aa, Human coronavirus
WLLY

SEQ ID NO: 425 - protein, 11 aa, Human coronavirus
VVIYWLVLLCT

SEQ ID NO: 426 - protein, 5 aa, Human coronavirus
AHYLP

SEQ ID NO: 427 - protein, 13 aa, Human coronavirus
VCCTTGDIPKHFY

SEQ ID NO: 428 - protein, 12 aa, Human coronavirus
PPSSSSRQFHRD

SEQ ID NO: 429 - protein, 5 aa, Human coronavirus
VFQKC

SEQ ID NO: 430 - protein, 4 aa, Human coronavirus
HQYT

SEQ ID NO: 431 - protein, 7 aa, Human coronavirus
FWFPNTD

SEQ ID NO: 432 - protein, 17 aa, Human coronavirus
YYITRSYLRDVVSSTSC

SEQ ID NO: 433 - protein, 5 aa, Human coronavirus
VLHRP

SEQ ID NO: 434 - protein, 47 aa, Human coronavirus
RAWQLYLLQQMAVVHLAWFHCWACCLSSMRLLHTVLHWLWHKLYGKT

SEQ ID NO: 435 - protein, 9 aa, Human coronavirus
IRGIRPRAA

SEQ ID NO: 436 - protein, 113 aa, Human coronavirus
GSCSLINELLMRVQRPPTLLLVFSLSLLVTASSKPLYVPEHCQNYSGCMLRACIKTAQADTAGLYTNFRIDVPSAESTGTQSVSVDLESTSTHDGPTEHVTSVNLFDVGYSVN

SEQ ID NO: 437 - protein, 37 aa, Human coronavirus
RTLWITCLCLIKFGRSTLTHRILLVCTSLNPQLSIHL

SEQ ID NO: 438 - protein, 291 aa, Human coronavirus
LALHCTLCCGTVSYPLLVILNLLLILQKLWPNRTQLSESLGCYIRMEESLMDVPSTSGTQVYSRKARKRSHSPTKKLRYVKRRFSLLRHEDLSVIVQPTHYVRVTFSDPNMWYLRSGHHLHSVHNWLKPYGGQPVSEYHITLALLNLTDEDLARDFSPIALFLRNVRFELHEFALLRKTLVLNASEIYCANIHRFKPVYRVNTAIPTIKDWLLVQGFSLYHSGLPLHMSISKLHALDDVTRNYIITMPCFRTYPQQMFVTPLAVDVVSIRSSNQGNKQIVHSYPILHHPGF

SEQ ID NO: 439 - protein, 109 aa, Human coronavirus
RTMAFSASLFKPVQLVPVSPAFHRIESTDSIVFTYIPASGYVAALAVNVCLIPLLLLLRQDTCRRSIIRTMVLYFLVLYNFLLAIVLVNGVHYPTGSCLIAFLVILIIL

SEQ ID NO: 440 - protein, 116 aa, Human coronavirus
FVDRIRFCLMLNSYIPLFDMRSHFIRVSTVSSHGMVPVIHTKPLFIRNFDQRCSCSRCFYLHSSTYIECTYISRFSKISLVSVTDFSLNGNVSTVFVPATRDSVPLHIIAPSSLIV

SEQ ID NO: 441 - protein, 107 aa, Human coronavirus
AALRYYGSRVEANPLVSLWTYGKRTMLPFVQERIGLFIVNFFIFTVVCAITLLVCMAFLTATRLCVQCMTGFNTLLVQPALYLYNTGRSVYVKFQDSKPPLPPDEWV

SEQ ID NO: 442 - protein, 4 aa, Human coronavirus
RTPS

SEQ ID NO: 443 - protein, 20 aa, Human coronavirus
RNSLRRRLLPLLKTGTLHGP

SEQ ID NO: 444 - protein, 13 aa, Human coronavirus
LLSYYSMDTHPVV

SEQ ID NO: 445 - protein, 30 aa, Human coronavirus
LSMSLKCLFYGSYGHLPWRYQYLAPFIQLI

SEQ ID NO: 446 - protein, 4 aa, Human coronavirus
SLAL

SEQ ID NO: 447 - protein, 5 aa, Human coronavirus
QLFQL

SEQ ID NO: 448 - protein, 13 aa, Human coronavirus
CGFPTLCRVSGCL

SEQ ID NO: 449 - protein, 15 aa, Human coronavirus
ELDHGGHSILRLIAF

SEQ ID NO: 450 - protein, 13 aa, Human coronavirus
TFHLVVQLSYVHS

SEQ ID NO: 451 - protein, 5 aa, Human coronavirus
RTLPV

SEQ ID NO: 452 - protein, 31 aa, Human coronavirus
PMATSKWLACISVLVTTTDFLMKSPWPNPMC

SEQ ID NO: 453 - protein, 70 aa, Human coronavirus
SGKATELIPALPFTIDIRQVITGVRLLRRILNLHCFELRLFSKSILIDFNESQFHCYGIPCCTSCCFLCR

SEQ ID NO: 454 - protein, 9 aa, Human coronavirus
YNKYKPISR

SEQ ID NO: 455 - protein, 8 aa, Human coronavirus
SKTTSCTK

SEQ ID NO: 456 - protein, 26 aa, Human coronavirus
HCLLVHWAYPTRESPSYLSTWAGCTS

SEQ ID NO: 457 - protein, 19 aa, Human coronavirus
CQFYPCAKCWVLAETGQKN

SEQ ID NO: 458 - protein, 5 aa, Human coronavirus
YREWN

SEQ ID NO: 459 - protein, 24 aa, Human coronavirus
ATGSQVVLLLHWNWTRSSTPIPGC

SEQ ID NO: 460 - protein, 7 aa, Human coronavirus
GWHRLGP

SEQ ID NO: 461 - protein, 4 aa, Human coronavirus
RWRH

SEQ ID NO: 462 - protein, 10 aa, Human coronavirus
CSFNFWDAEP

SEQ ID NO: 463 - protein, 11 aa, Human coronavirus
FSYCYTIRARY

SEQ ID NO: 464 - protein, 4 aa, Human coronavirus
KLPH

SEQ ID NO: 465 - protein, 5 aa, Human coronavirus
GDWRQ

SEQ ID NO: 466 - protein, 7 aa, Human coronavirus
SIIFKSL

SEQ ID NO: 467 - protein, 8 aa, Human coronavirus
LKQKLFQI

SEQ ID NO: 468 - protein, 25 aa, Human coronavirus
FTRFKIRKLYPRHFSRSIWNRSSRR

SEQ ID NO: 469 - protein, 4 aa, Human coronavirus
STLP

SEQ ID NO: 470 - protein, 8 aa, Human coronavirus
SSEQTTSP

SEQ ID NO: 471 - protein, 13 aa, Human coronavirus
VWQSKAIAAKSNH

SEQ ID NO: 472 - protein, 6 aa, Human coronavirus
ERCCCC

SEQ ID NO: 473 - protein, 30 aa, Human coronavirus
DAPQAHFHQKFQHGASFWSSRTRRPPGKLW

SEQ ID NO: 474 - protein, 4 aa, Human coronavirus
SSIE

SEQ ID NO: 475 - protein, 8 aa, Human coronavirus
GPTLAPNC

SEQ ID NO: 476 - protein, 14 aa, Human coronavirus
ACSYSQCFYGYVAI

SEQ ID NO: 477 - protein, 6 aa, Human coronavirus
TYPSEQ

SEQ ID NO: 478 - protein, 14 aa, Human coronavirus
SWQPCVLPSVQWSH

SEQ ID NO: 479 - protein, 7 aa, Human coronavirus
PKESQLQ

SEQ ID NO: 480 - protein, 5 aa, Human coronavirus
VVGAS

SEQ ID NO: 481 - protein, 6 aa, Human coronavirus
CLQNLP

SEQ ID NO: 482 - protein, 17 aa, Human coronavirus
EGKETKGTKRRINRPNV

SEQ ID NO: 483 - protein, 9 aa, Human coronavirus
TSKGAACAR

SEQ ID NO: 484 - protein, 17 aa, Human coronavirus
HHSAHSHPSKCSAWSND

SEQ ID NO: 485 - protein, 38 aa, Human coronavirus
LVSLKVTRSRQSFVFGNPISPSLVHSCTEWNHVVITVQ

SEQ ID NO: 486 - protein, 7 aa, Human coronavirus
GNYNPFN

SEQ ID NO: 487 - protein, 36 aa, Human coronavirus
LCFIKVCSCRENVKDCHLCLIASEQCPPGRALQCEM

SEQ ID NO: 488 - protein, 7 aa, Human coronavirus
IKNSYYS

SEQ ID NO: 489 - DNA, 30078 bp, Human coronavirus; identical to SEQ ID NO: 15
  CDS (2)..(30076)

SEQ ID NO: 490 - protein, 26 aa, Human coronavirus
IAWLSHFPSFSCRTLILTNLNKSPVV

SEQ ID NO: 491 - protein, 31 aa, Human coronavirus
RIVALVWWDCGINLPAHLGSGHMLNTGYNSN

SEQ ID NO: 492 - protein, 5 aa, Human coronavirus
ILFFS

SEQ ID NO: 493 - protein, 4415 aa, Human coronavirus
SVVSLVRLGHNTRFRPVRGNSGHIMSFVAGVTAQGARGTYRAALNSEKHQDHVSLTVPLCGSGNLVEKLSPWFMDGENAYEVVKAMLLKKEPLLYVPIRLAGHTRHLPGPRVYLVERLIACENPFMVNQLAYSSSANGSLVGTTLQGKPIGMFFPYDIELVTGKQNILLRKYGRGGYHYTPFHYERDNTSCPEWMDDFEADPKGKYAQNLLKKLIGGDVTPVDQYMCGVDGKPISAYAFLMAKDGITKLADVEADVAARADDEGFITLKNNLYRLVWHVERKDVPYPKQSIFTINSVVQKDGVENTPPHYFTLGCKILTLTPRNKWSGVSDLSLKQKLLYTFYGKESLENPTYIYHSAFIECGSCGNDSWLTGNAIQGFACGCGASYTANDVEVQSSGMIKPNALLCATCPFAKGDSCSSNCKHSVAQLVSYLSERCNVIADSKSFTLIFGGVAYAYFGCEEGTMYFVPRAKSVVSRIGDSIFTGCTGSWNKVTQIANMFLEQTQHSLNFVGEFVVNDVVLAILSGTTTNVDKIRQLLKGVTLDKLRDYLADYDVAVTAGPFMDNAINVGGTGLQYAAITAPYVVLTGLGESFKKVATIPYKVCNSVKDTLAYYAHSVLYRVFPYDMDSGVSSFSELLFDCVDLSVASTYFLVRILQDKTGDFMSTIITSCQTAVSKLLDTCFEATEATFNFLLDLAGLFRIFLRNAYVYTSQGFVVVNGKVSTLVKQVLDLLNKGMQLLHTKVSWAGSKIIAVIYSGRESLIFPSGTYYCVTTKAKSVQQDLDVILPGEFSKKQLGLLQPTDNSTTVSVTVSSNMVETVVGQLEQTNMHSPDVIVGDYVIISEKLFVRSKEEDGFAFYPACTNGHAVPTLFRLKGGAPSKKVAFGGDQVHEVAAVRSVTVEYNIHAVLDTLLASSSLRTFVVDKSLSIEEFADVVKEQVSDLLVKLLRGMPIPDFDLDDFIDAPCYCFNAEGDASWSSTMIFSLHPVECDEECSEVEASDLEEGESECISETSTEQVDVSHETSDDEWAAAVDEAFPLDEAEDVTESVQEEAQPVEVPVEDIAQVVIADTLQETPVVPDTVEVPPQVVKLPSAPQTIQPEVKEVAPVYEADTEQTQNVTVKPKRLRKKRNVDPLSNFEHKVITECVTIVLGDAIQVAKCYGESVLVNAANTHLKHGGGIAGAINAASKGAVQKESDEYILAKGPLQVGDSVLLQGHSLAKNILHVVGPDARAKQDVSLLSKCYKAMNAYPLVVTPLVSAGIFGVKPAVSFDYLIREAKTRVLVVVNSQDVYKSLTIVDIPQSLTFSYDGLRGAIRKAKDYGFTVFVCTDNSANTKVLRNKGVDYTKKFLTVDGVQYYCYTSKDTLDDILQQANKSVGIISMPLGYVSHGLDLMQAGSVVRRVNVPYVCLLANKEQEAILMSEDVKLNPSEDFIKHVRTNGGYNSWHLVEGELLVQDLRLNKLLHWSDQTICYKDSVFYVVKNSTAFPFETLSACRAYLDSRTTQQLTIEVLVTVDGVNFRTVVLNNKNTYRSQLGCVFFNGADISDTIPDEKQNGHSLYLADNLTADETKALKELYGPVDPTFLHRFYSLKAAVHGWKMVVCDKVRSLKLSDNNCYLNAVIMTLDLLKDIKFVIPALQHAFMKHKGGDSTDFIALIMAYGNCTFGAPDDASRLLHTVLAKAELCCSARMVWREWCNVCGIKDVVLQGLKACCYVGVQTVEDLRARMTYVCQCGGERHRQLVEHTTPWLLLSGTPNEKLVTTSTAPDFVAFNVFQGIETAVGHYVHARLKGGLILKFDSGTVSKTSDWKCKVTDVLFPGQKYSSDCNVVRYSLDGNFRTEVDPDLSAFYVKDGKYFTSEPPVTYSPATILAGSVYTNSCLVSSDGQPGGDAISLSFNNLLGFDSSKPVTKKYTYSFLPKEDGDVLLAEFDTYDPIYKNGAMYKGKPILWVNKASYDTNLNKFNRASLRQIFDVAPIELENKFTPLSVESTPVEPPTVDVVALQQEMTIVKCKGLNKPFVKDNVSFVADDSGTPVVEYLSKEDLHTLYVDPKYQVIVLKDNVLSSMLRLHTVESGDINVVAASGSLTRKVKLLFRASFYFKEFATRTFTATTAVGSCIKSVVRHLGVTKGILTGCFSFAKMLFMLPLAYFSDSKLGTTEVKVSALKTAGVVTGNVVKQCCTAAVDLSMDKLRRVDWKSTLRLLLMLCTTMVLLSSVYHLYVFNQVLSSDVMFEDAQGLKKFYKEVRAYLGISSACDGLASAYRANSFDVPTFCANRSAMCNWCLISQDSITHYPALKMVQTHLSHYVLNIDWLWFAFETGLAYMLYTSAFNWLLLAGTLHYFFAQTSIFVDWRSYNYAVSSAFWLFTHIPMAGLVRMYNLLACLWLLRKFYQHVINGCKDTACLLCYKRNRLTRVEASTVVCGGKRTFYITANGGISFCRRHNWNCVDCDTAGVGNTFICEEVANDLTTALRRPINATDRSHYYVDSVTVKETVVQFNYRRDGQPFYERFPLCAFTNLDKLKFKEVCKTTTGIPEYNFIIYDSSDRGQESLARSACVYYSQVLCKSILLVDSSLVTSVGDSSEIATKMFDSFVNSFVSLYNVTRDKLEKLISTARDGVRRGDNFHSVLTTFIDAARGPAGVESDVETNEIVDSVQYAHKHDIQITNESYNNYVPSYVKPDSVSTSDLGSLIDCNAASVNQIVLRNSNGACIWNAAAYMKLSDALKRQIRIACRKCNLAFRLTTSKLRANDNILSVRFTANKIVGGAPTWFNALRDFTLKGYVLATIIVFLCAVLMYLCLPTFSMAPVEFYEDRILDFKVLDNGIIRDVNPDDKCFANKHRSFTQWYHEHVGGVYDNSITCPLTVAVIAGVAGARIPDVPTTLAWVNNQIIFFVSRVFANTGSVCYTPIDEIPYKSFSDSGCILPSECTMFRDAEGRMTPYCHDPTVLPGAFAYSQMRPHVRYDLYDGNMFIKFPEVVFESTLRITRTLSTQYCRFGSCEYAQEGVCITTNGSWAIFNDHHLNRPGVYCGSDFIDIVRRLAVSLFQPITYFQLTTSLVLGIGLCAFLTLLFYYINKVKRAFADYTQCAVIAVVAAVLNSLCICFVTSIPLCIVPYTALYYYATFYFTNEPAFIMHVSWYIMFGPIVPIWMTCVYTVAMCFRHFFWVLAYFSKKHVEVFTDGKLNCSFQDAASNIFVINKDTYAALRNSLTNDAYSRFLGLFNKYKYFSGAMETAAYREAAACHLAKALQTYSETGSDLLYQPPNCSITSGVLQSGLVKMSHPSGDVEACMVQVTCGSMTLNGLWLDNTVWCPRHVMCPADQLSDPNYDALLISMTNHSFSVQKHIGAPANLRVVGHAMQGTLLKLTVDVANPSTPAYTFTTVKPGAAFSVLACYNGRPTGTFTVVMRPNYTIKGSFLCGSCGSVGYTKEGSVINFCYMHQMELANGTHTGSAFDGTMYGAFMDKQVHQVQLTDKYCSVNVVAWLYAAILNGCAWFVKPNRTSVVSFNEWALANQFTEFVGTQSVDMLAVKTGVAIEQLLYAIQQLYTGFQGKQILGSTMLEDEFTPEDVNMQIMGVVMQSGVRKVTYGTAHWLFATLVSTYVIILQATKFTLWNYLFETIPTQLFPLLFVTMAFVMLLVKHKHTFLTLFLLPVAICLTYANIVYEPTTPISSALIAVANWLAPTNAYMRTTHTDIGVYISMSLVLVIVVKRLYNPSLSNFALALCSGVMWLYTYSIGEASSPIAYLVFVTTLTSDYTITVFVTVNLAKVCTYAIFAYSPQLTLVFPEVKMILLLYTCLGFMCTCYFGVFSLLNLKLRAPMGVYDFKVSTQEFRFMTANNLTAPRNSWEAMALNFKLIGIGGTPCIKVAAMQSKLTDLKCTSVVLLSVLQQLHLEANSRAWAFCVKCHNDILAATDPSEAFEKFVSLFATLMTFSGNVDLDALASDIFDTPSVLQATLSEFSHLATFAELEAAQKAYQEAMDSGDTSPQVLKALQKAVNIAKNAYEKDKAVARKLERMADQAMTSMYKQARAEDKKAKIVSAMQTMLFGMIKKLDNDVLNGIISNARNGCIPLSVIPLCASNKLRVVIPDFTVWNQVVTYPSLNYAGALWDITVINNVDNEIVKSSDVVDSNENLTWPLVLECTRASTSAVKLQNNEIKPSGLKTMVVSAGQEQTNCNTSSLAYYEPVQGRKMLMALLSDNAYLKWARVEGKDGFVSVELQPPCKFLIAGPKGPEIRYLYFVKNLNNLHRGQVLGHIAATVRLQAGSNTEFASNSSVLSLVNFTVDPQKAYLDFVNAGGAPLTNCVKMLTPKTGTGIAISVKPESTADQETYGGASVCLYCRAHIEHPDVSGVCKYKGKFVQIPAQCVRDPVGFCLSNTPCNVCQYWIGYGCNCDSLRQAALPQSKDSNFLNESGVLL

SEQ ID NO: 494 - protein, 39 aa, Human coronavirus
NPVQVVCPLMSSLGHLTSATIRLRLLVLENTTRLILVGL

SEQ ID NO: 495 - protein, 6 aa, Human coronavirus
MTKGII

SEQ ID NO: 496 - protein, 15 aa, Human coronavirus
TPILSLRGILWRIMN

SEQ ID NO: 497 - protein, 13 aa, Human coronavirus
RSTVTTCYVTVML

SEQ ID NO: 498 - protein, 9 aa, Human coronavirus
LPMISSSLM

SEQ ID NO: 499 - protein, 12 aa, Human coronavirus
TKLKHLILYVSV

SEQ ID NO: 500 - protein, 4 aa, Human coronavirus
LSTL

SEQ ID NO: 501 - protein, 6 aa, Human coronavirus
WILYMP

SEQ ID NO: 502 - protein, 13 aa, Human coronavirus
GTLIKIAKCLRLS

SEQ ID NO: 503 - protein, 39 aa, Human coronavirus
SMVAVMLPTLKINSGLILLKIPVLLVFIINLENVYAKLS

SEQ ID NO: 504 - protein, 13 aa, Human coronavirus
TLLNFVTTWSRLV

SEQ ID NO: 505 - protein, 5 aa, Human coronavirus
SVCSH

SEQ ID NO: 506 - protein, 15 aa, Human coronavirus
TTRTLMASGMILVTS

SEQ ID NO: 507 - protein, 7 aa, Human coronavirus
SLNLVQE

SEQ ID NO: 508 - protein, 7 aa, Human coronavirus
LIATILI

SEQ ID NO: 509 - protein, 5 aa, Human coronavirus
CLCSQ

SEQ ID NO: 510 - protein, 71 aa, Human coronavirus
PIVWPLRHIGIVILINHSLSGHLLSMILLIIRYNSLRSTLNIGIRRITQIALIVLMTVVCYIVLISMYCLL

SEQ ID NO: 511 - protein, 9 aa, Human coronavirus
PCLRLVSDP

SEQ ID NO: 512 - protein, 11 aa, Human coronavirus
SERSLLMACHL

SEQ ID NO: 513 - protein, 9 aa, Human coronavirus
YLVVITTKN

SEQ ID NO: 514 - protein, 15 aa, Human coronavirus
IWMLVSIDIGSLLRS

SEQ ID NO: 515 - protein, 18 aa, Human coronavirus
CMPLIQPCTLPPLTLFLI

SEQ ID NO: 516 - protein, 13 aa, Human coronavirus
GHHVLVSLHLQLV

SEQ ID NO: 517 - protein, 29 aa, Human coronavirus
LFKLCGLAILTKTSMISWYLKVSLRRALQ

SEQ ID NO: 518 - protein, 40 aa, Human coronavirus
RSNIFSLLKMVMLLLQIIITILIICLLCVTSNKCCSAWKL

SEQ ID NO: 519 - protein, 21 aa, Human coronavirus
TSTSKSMTVVVLMLLKWLLII

SEQ ID NO: 520 - protein, 31 aa, Human coronavirus
TRVLAILLISLAKLVSIMRACLTRSKMNFLP

SEQ ID NO: 521 - protein, 8 aa, Human coronavirus
QSVTSFLP

SEQ ID NO: 522 - protein, 21 aa, Human coronavirus
NMLLVLRIELALLQACPYLAQ

SEQ ID NO: 523 - protein, 71 aa, Human coronavirus
LIASTIRKCLSPWLQLVERLASLVLQSSTVAGISCLKHCTKMLIIRILWVGITLSVIELCLICVESSLHSY

SEQ ID NO: 524 - protein, 24 aa, Human coronavirus
LVNMALVVLQGTDFIAWQMSVLRC

SEQ ID NO: 525 - protein, 91 aa, Human coronavirus
ANMFYVVVVTTSNLEVPVAEMPPLHMPIVSLTFCRRQLLMSVHLWVLMATRLLTKKLKTCSLICMSMFTGALAQTPNLLINTMLFLISTFL

SEQ ID NO: 526 - protein, 48 aa, Human coronavirus
YCLMTVSFAIIVIMQLRVTLLEYRILRKRCIIRTMSLCLKLNAGWKPI

SEQ ID NO: 527 - protein, 38 aa, Human coronavirus
RKGHMNSVHSIRFILRMATMVTSFLIQTLQEFCLPVAL

SEQ ID NO: 528 - protein, 11 aa, Human coronavirus
MISLRLTVHSW

SEQ ID NO: 529 - protein, 7 aa, Human coronavirus
SGLCLWL

SEQ ID NO: 530 - protein, 10 aa, Human coronavirus
MLTLSQSMKI

SEQ ID NO: 531 - protein, 12 aa, Human coronavirus
NTRMYSGSTYSI

SEQ ID NO: 532 - protein, 78 aa, Human coronavirus
KNCIKTLQDTCLTVILSCYVVIILLSFGKRHSIEISIVRLPLCRLSVHALYAIHRLPYAVGHASVDHFSAVNAAMIML

SEQ ID NO: 533 - protein, 29 aa, Human coronavirus
QLHIRWFCLFLLTFVMPLVVAFQTLLSYI

SEQ ID NO: 534 - protein, 4 aa, Human coronavirus
ATFV

SEQ ID NO: 535 - protein, 29 aa, Human coronavirus
IIDLCVVFHFALMVLYSAYTRICAQVVLL

SEQ ID NO: 536 - protein, 83 aa, Human coronavirus
LNLIGWLPVTGLKVVITPLPILQQNHSNFLLLRLYVPLKRRLSSLMLLPPSKKLLVSANYYLCGRLASPNHHSIVIMFLLVII

SEQ ID NO: 537 - protein, 31 aa, Human coronavirus
PKIVKCSSVSTFSSALIIVMLYPTSLVQRIN

SEQ ID NO: 538 - protein, 13 aa, Human coronavirus
VTSSYLPLTLWLP

SEQ ID NO: 539 - protein, 5 aa, Human coronavirus
RRPQL

SEQ ID NO: 540 - protein, 51 aa, Human coronavirus
IKRGMLKLLGCTQPLRYLKSSQVMLPTSKNQVIVNMSLFRDHLALAKVILL

SEQ ID NO: 541 - protein, 29 aa, Human coronavirus
RFTTLQHVLFIQHVHTQLLMLCVKKLLNI

SEQ ID NO: 542 - protein, 73 aa, Human coronavirus
TLLNVPVSFLQRHVLSAMTGLKLMRQILNICLVLLMLYQKLLPIFWWLMRLVCALIMIFQLLMHVLKLSTLSM

SEQ ID NO: 543 - protein, 12 aa, Human coronavirus
EIQHSCQLLGLC

SEQ ID NO: 544 - protein, 15 aa, Human coronavirus
LEAHWNQKISIVSLD

SEQ ID NO: 545 - protein, 5 aa, Human coronavirus
VLTYF

SEQ ID NO: 546 - protein, 9 aa, Human coronavirus
VCATGVLRK

SEQ ID NO: 547 - protein, 9 aa, Human coronavirus
ALLSTIINC

SEQ ID NO: 548 - protein, 17 aa, Human coronavirus
PRRSFQASALKYSIRAM

SEQ ID NO: 549 - protein, 15 aa, Human coronavirus
RMMLALPLIDHNSHL

SEQ ID NO: 550 - protein, 79 aa, Human coronavirus
RILLLPIRHGVRQSLFRLTIHRMLCLVQCWVLPLRLLIPHRVQNTSTLSSVKQQIRHMLTTLTDLMLQSLVPKKVFFVL

SEQ ID NO: 551 - protein, 8 aa, Human coronavirus
HLRHSLSP

SEQ ID NO: 552 - protein, 16 aa, Human coronavirus
SLLNCLLLITSSSLRL

SEQ ID NO: 553 - protein, 36 aa, Human coronavirus
LAFLKIALEKLLASHLLMHQHMLVLMTSIRRVMSFA

SEQ ID NO: 554 - protein, 38 aa, Human coronavirus
ILIYPQMSHTLVLFPGWALNSMQQFLDILSFSLLVKRL

SEQ ID NO: 555 - protein, 6 aa, Human coronavirus
GKFEAG

SEQ ID NO: 556 - protein, 21 aa, Human coronavirus
ASMLRVLMLPVMHVAPMCLYN

SEQ ID NO: 557 - protein, 5 aa, Human coronavirus
DFQLV

SEQ ID NO: 558 - protein, 9 aa, Human coronavirus
TLLFSQLVL

SEQ ID NO: 559 - protein, 7 aa, Human coronavirus
TLSGVTC

SEQ ID NO: 560 - protein, 32 aa, Human coronavirus
RALLHVLHQVNSLSTSCLLCIRGLRGLLLDDV

SEQ ID NO: 561 - protein, 7 aa, Human coronavirus
CKCCQTL

SEQ ID NO: 562 - protein, 17 aa, Human coronavirus
TNCLITVRLFVGLMALN

SEQ ID NO: 563 - protein, 8 aa, Human coronavirus
RLHHTFAR

SEQ ID NO: 564 - protein, 48 aa, Human coronavirus
VRNRSVACAIDALQRTLHLCNLMPAGLIPAVMIMSTTLSLSMFNSGVM

SEQ ID NO: 565 - protein, 24 aa, Human coronavirus
AILLLITIVIALSIKELMWLLMMQ

SEQ ID NO: 566 - protein, 6 aa, Human coronavirus
LFILVL

SEQ ID NO: 567 - protein, 6 aa, Human coronavirus
NVWIGI

SEQ ID NO: 568 - protein, 10 aa, Human coronavirus
SILISHMKRN

SEQ ID NO: 569 - protein, 50 aa, Human coronavirus
IPVVESLSATSYVLLFLPVHLTKSMILAILKEFLLLMTLWLIGIILMHSP

SEQ ID NO: 570 - protein, 72 aa, Human coronavirus
PGRYNSFSIQRTWPQDLLMGSAYFGTVMYQNILIMQLYAGLTHVCILSSICQVVMAVVCMLTSTLFIHQHMM

SEQ ID NO: 571 - protein, 5 aa, Human coronavirus
VHSVI

SEQ ID NO: 572 - protein, 20 aa, Human coronavirus
NLYHSFIILLHHVKCMVMVV

SEQ ID NO: 573 - protein, 7 aa, Human coronavirus
RILIMYP

SEQ ID NO: 574 - protein, 10 aa, Human coronavirus
NLQSVLQLVI

SEQ ID NO: 575 - protein, 71 aa, Human coronavirus
GALFVGSMLQSTESIWKHIILSLHQVSAFGVIRPLIFIISGLLLQKFKVWKTLLLMLLNKAILLVLRVNYL

SEQ ID NO: 576 - protein, 26 aa, Human coronavirus
SMIRSSPRVALMTFVCLRIKPLCLLI

SEQ ID NO: 577 - protein, 59 aa, Human coronavirus
LLNSMLSVLYARIPISNCYTIYKQTFATSSSFGIMNVAIFMVLLLLVYVSTLILMLIQL

SEQ ID NO: 578 - protein, 35 aa, Human coronavirus
IYVLTYAIIVHWRSSCLLPMPSLFLIEKSRNTLVW

SEQ ID NO: 579 - protein, 21 aa, Human coronavirus
VLIMLTSMVLSSVIVMLLNNQ

SEQ ID NO: 580 - protein, 60 aa, Human coronavirus
SSTCIRKSIMSLLILLSVFTLRVALVVTSYPFLTWRKTFYLLIVMFSLRSMAWKTMLLST

SEQ ID NO: 581 - protein, 9 aa, Human coronavirus
SMETSLILR

SEQ ID NO: 582 - protein, 23 aa, Human coronavirus
AVFTCLLVYTRSNRKVILLWKKC

SEQ ID NO: 583 - protein, 25 aa, Human coronavirus
KVAQLFITILLLRLTQRLLRRCVLL

SEQ ID NO: 584 - protein, 6 aa, Human coronavirus
SLTTLL

SEQ ID NO: 585 - protein, 6 aa, Human coronavirus
RVKTLA

SEQ ID NO: 586 - protein, 10 aa, Human coronavirus
YPRLSRFLLT

SEQ ID NO: 587 - protein, 39 aa, Human coronavirus
LSLCYGVRMDRFKPSTLDSRLLQIGNLVMQCHPSLKFKM

SEQ ID NO: 588 - protein, 21 aa, Human coronavirus
TLNVVSLLITSNLFLCLAVCT

SEQ ID NO: 589 - protein, 11 aa, Human coronavirus
TSLNICNCASI

SEQ ID NO: 590 - protein, 4 aa, Human coronavirus
ILAH

SEQ ID NO: 591 - protein, 36 aa, Human coronavirus
PCLPICVLYILALVLIKVSLLVPQFYDSGFLQMPLL

SEQ ID NO: 592 - protein, 8 aa, Human coronavirus
MSSCQMLT

SEQ ID NO: 593 - protein, 6 aa, Human coronavirus
LYLEIV

SEQ ID NO: 594 - protein, 22 aa, Human coronavirus
LYVSANKWILLFPTCMILLLRM

SEQ ID NO: 595 - protein, 31 aa, Human coronavirus
QVVMSQRLYSLLTCVTSLIIILLLVGLLLLK

SEQ ID NO: 596 - protein, 35 aa, Human coronavirus
QNTLGALNFMNLWENLLGGLFSAPMQMHPHLKDSS

SEQ ID NO: 597 - protein, 11 aa, Human coronavirus
VLITWVLLKKI

SEQ ID NO: 598 - protein, 17 aa, Human coronavirus
MVVLCTPTIYFGEIPLL

SEQ ID NO: 599 - protein, 12 aa, Human coronavirus
VLTHFLIYPSFN

SEQ ID NO: 600 - protein, 7 aa, Human coronavirus
KEHQFFN

SEQ ID NO: 601 - protein, 8 aa, Human coronavirus
RRVKLTNS

SEQ ID NO: 602 - protein, 1366 aa, Human coronavirus
YLSCRRVSYLSVTMIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFQKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 603 - protein, 4 aa, Human coronavirus
LTNY

SEQ ID NO: 604 - protein, 9 aa, Human coronavirus
EFKDHPLSC

SEQ ID NO: 605 - protein, 81 aa, Human coronavirus
CFHSLFWSLHPQNLSMYLSIVRIILVACLGLVLKLPKLIQLVFIQIFELTSHLQNQLVLNQFLSILSQLQLMMVLPNMLLV

SEQ ID NO: 606 - protein, 20 aa, Human coronavirus
IFLTLVTQLINELYGLRVSA

SEQ ID NO: 607 - protein, 7 aa, Human coronavirus
SNLAEVP

SEQ ID NO: 608 - protein, 10 aa, Human coronavirus
LTVYYLFVHP

SEQ ID NO: 609 - protein, 24 aa, Human coronavirus
VYTFSWHFIAPCAVELSAILCWLY

SEQ ID NO: 610 - protein, 19 aa, Human coronavirus
FYKSFGQTGRSSANRLVAT

SEQ ID NO: 611 - protein, 5 aa, Human coronavirus
GWRNP

SEQ ID NO: 612 - protein, 91 aa, Human coronavirus
WMFPLPPALKFIRAKRGRGAILQLRNCATLSVDFLFCAMKTLVLLSNQHTMSGLHFQTPTCGIYVRVIIYTQFTIGLNLMAANLFLSTILL

SEQ ID NO: 613 - protein, 6 aa, Human coronavirus
ISLMKI

SEQ ID NO: 614 - protein, 111 aa, Human coronavirus
LEIFHPLRSFCAMSDLSYMSSPCCAKLLFLMHQRSTVLTYIDLSLCIELTRQSLLLRIGFSFRDFPFTIVASLYICQSLNCMHWMMLLAITSLQCHALELTLNKCLLLLWP

SEQ ID NO: 615 - protein, 42 aa, Human coronavirus
MLSPYGLPIRVINKLFILIPFYIIQDFNELWLSRRLYLNPSS

SEQ ID NO: 616 - protein, 26 aa, Human coronavirus
SQFLLHFIALSLLTLLFSHTFLLAAM

SEQ ID NO: 617 - protein, 37 aa, Human coronavirus
LSMCVSFPYYYCYVKILVVAALSELWFSISLFCITFY

SEQ ID NO: 618 - protein, 11 aa, Human coronavirus
SMVYIIQLEVA

SEQ ID NO: 619 - protein, 4 aa, Human coronavirus
YFSL

SEQ ID NO: 620 - protein, 8 aa, Human coronavirus
IEFVSVSC

SEQ ID NO: 621 - protein, 26 aa, Human coronavirus
IPTFHCLTCVPTLFVLVQFLLMVWSL

SEQ ID NO: 622 - protein, 28 aa, Human coronavirus
YTPNHYLLETSISVAAVLVVFICTLPLI

SEQ ID NO: 623 - protein, 12 aa, Human coronavirus
SALILAVLVRLA

SEQ ID NO: 624 - protein, 4 aa, Human coronavirus
LTSP

SEQ ID NO: 625 - protein, 19 aa, Human coronavirus
TAMFPLFSCLQRAIQFLFT

SEQ ID NO: 626 - protein, 18 aa, Human coronavirus
SPRARLSFKQLCATMGPV

SEQ ID NO: 627 - protein, 4 aa, Human coronavirus
RLIH

SEQ ID NO: 628 - protein, 18 aa, Human coronavirus
SLFGHMENELCYPLSKNE

SEQ ID NO: 629 - protein, 6 aa, Human coronavirus
TFSFLP

SEQ ID NO: 630 - protein, 18 aa, Human coronavirus
HSWCVWLSLRLLDYVCNV

SEQ ID NO: 631 - protein, 6 aa, Human coronavirus
QASIPC

SEQ ID NO: 632 - protein, 15 aa, Human coronavirus
FSPHYTCIILDVQSM

SEQ ID NO: 633 - protein, 22 aa, Human coronavirus
NSRIVNPLYHLTSGFNELLHNV

SEQ ID NO: 634 - protein, 5 aa, Human coronavirus
YDATH

SEQ ID NO: 635 - protein, 7 aa, Human coronavirus
GADYCHY

SEQ ID NO: 636 - protein, 24 aa, Human coronavirus
RLELCMVPDLSLNYYRTTVWIPIP

SEQ ID NO: 637 - protein, 6 aa, Human coronavirus
YDCLCL

SEQ ID NO: 638 - protein, 17 aa, Human coronavirus
NVCFMAPMAIFHGAINI

SEQ ID NO: 639 - protein, 5 aa, Human coronavirus
RRLSN

SEQ ID NO: 640 - protein, 40 aa, Human coronavirus
SSFPDNLWHCSSCFSYDVDFLLCAEYPAVYENWIMVVIQS

SEQ ID NO: 641 - protein, 42 aa, Human coronavirus
LPFERSIWWYNCRTSTRRGLYQCNCCCNQWPPQNGWHAFRCL

SEQ ID NO: 642 - protein, 5 aa, Human coronavirus
LRQTS

SEQ ID NO: 643 - protein, 22 aa, Human coronavirus
SHRGQTQCADCFKNGEAAKLRN

SEQ ID NO: 644 - protein, 7 aa, Human coronavirus
FRRCHLP

SEQ ID NO: 645 - protein, 10 aa, Human coronavirus
LQESAYYGGY

SEQ ID NO: 646 - protein, 14 aa, Human coronavirus
TCIASSLGSLVRVS

SEQ ID NO: 647 - protein, 423 aa, Human coronavirus
LILTNLNFIVMASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSLSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 648 - protein, 4 aa, Human coronavirus
CHSK

SEQ ID NO: 649 - protein, 27 aa, Human coronavirus
QDRGNRLCLATPSHHRLSTLAQNGIML

SEQ ID NO: 650 - protein, 33 aa, Human coronavirus
LQCNKVIITHLIDSYALLKCVAVERMLKTVTSA

SEQ ID NO: 651 - protein, 17 aa, Human coronavirus
LQVNSAPREELYSVKCK

SEQ ID NO: 652 - protein, 5 aa, Human coronavirus
KIAII

SEQ ID NO: 653 - DNA, 30078 bp, Human coronavirus; identical to SEQ ID NO: 15
  CDS (3)..(30077)

SEQ ID NO: 654 - protein, 13 aa, Human coronavirus
LGYLTSPRSLAEL

SEQ ID NO: 655 - protein, 24 aa, Human coronavirus
IKALLFSVSLHLSGGIVALICLLI

SEQ ID NO: 656 - protein, 50 aa, Human coronavirus
AVDICSTLGIILIEYYFSVRASCLLYVSVTIHGFVRCVAIRGTSCLSWLV

SEQ ID NO: 657 - protein, 23 aa, Human coronavirus
PRKVRAVRIEQRSTLKNIKTMCL

SEQ ID NO: 658 - protein, 27 aa, Human coronavirus
LCHSVVQETWLKNFHHGSWMAKMPMKW

SEQ ID NO: 659 - protein, 130 aa, Human coronavirus
RPCYLKRSHFSMCPSGWLDTLDTSQVLVCTWLRGSLLVKIHSWLTNWLIALVQMAAWLAQLCRASLLVCSSLMTSNLSQESKIFSCASMAVVVITTPHSTMSETTPLALSGWTILRRILKANMPRICLRS

SEQ ID NO: 660 - protein, 25 aa, Human coronavirus
LAVMSLQLTNTCVALMENPLVPTHF

SEQ ID NO: 661 - protein, 5 aa, Human coronavirus
WPRME

SEQ ID NO: 662 - protein, 21 aa, Human coronavirus
PNWLMLKRTSQHVLMTKASSH

SEQ ID NO: 663 - protein, 49 aa, Human coronavirus
RTIYIDWFGMLSVKTFHILSNLFLLLIVWSKRMVLKTLLLTILLLDAKF

SEQ ID NO: 664 - protein, 80 aa, Human coronavirus
RSPHATSGVAFLTCPSNKNSFTPSMVRSHLRTQPTFTTPHSLSVEVVVMIPGLQGMLSKGLPVDVGHHIQLMMSKSNHLA

SEQ ID NO: 665 - protein, 53 aa, Human coronavirus
LSQMLFFVLLAPLLRVIAVLLIANIQLLSWLVTFLNAVMLLLILSPSHLSLVA

SEQ ID NO: 666 - protein, 96 aa, Human coronavirus
LTPTLDVRKVLCTLCLELSLLSQGLETPSLQAVLALGTRSLKLLTCSWNRLSIPLTLWESSLSTMLSSQFSLEPQLMLTKYASFSKVSPLTSCVII

SEQ ID NO: 667 - protein, 4 aa, Human coronavirus
LTMT

SEQ ID NO: 668 - protein, 28 aa, Human coronavirus
QSLPAHSWIMLLMLVVQDYSMPPLLHLM

SEQ ID NO: 669 - protein, 4 aa, Human coronavirus
FSLA

SEQ ID NO: 670 - protein, 56 aa, Human coronavirus
VSPLRKLQPYRIRFATLLRILWLIMLTACCTEFFLMTWILVCHPLVNYFLIALIFQ

SEQ ID NO: 671 - protein, 5 aa, Human coronavirus
LLPIF

SEQ ID NO: 672 - protein, 26 aa, Human coronavirus
SASCKIRLATLCLQLLLPAKLLLVSF

SEQ ID NO: 673 - protein, 14 aa, Human coronavirus
IHVLKLQKQHLTSC

SEQ ID NO: 674 - protein, 35 aa, Human coronavirus
IWQDCSESFSAMPMCTLHKGLWWSMAKFLHLSNKC

SEQ ID NO: 675 - protein, 31 aa, Human coronavirus
TCLIRVCNFCIQRSPGLVLKSLLLSTAAGSL

SEQ ID NO: 676 - protein, 33 aa, Human coronavirus
YSHREPITVSPLRLSPFNKILTLFCLVSFPRSS

SEQ ID NO: 677 - protein, 38 aa, Human coronavirus
DCSNLLTILQLLVLLYPVTWLKLLWVNLSKLICIVLML

SEQ ID NO: 678 - protein, 46 aa, Human coronavirus
VTMSLLVKNCLCVVRKKTDLPSTLLALMVMLYRLSLDLREVHLVKK

SEQ ID NO: 679 - protein, 12 aa, Human coronavirus
PLAVIKYMRLLL

SEQ ID NO: 680 - protein, 12 aa, Human coronavirus
EVLLSSTTFMLY

SEQ ID NO: 681 - protein, 13 aa, Human coronavirus
THYLLLLVLEPLL

SEQ ID NO: 682 - protein, 11 aa, Human coronavirus
ISLCQLRSLLT

SEQ ID NO: 683 - protein, 21 aa, Human coronavirus
RNKSQTCLLNYCVECRFQILI

SEQ ID NO: 684 - protein, 22 aa, Human coronavirus
TILLTHHAIALTLRVMHPGLLL

SEQ ID NO: 685 - protein, 15 aa, Human coronavirus
SSLFTPSSVTRSVLK

SEQ ID NO: 686 - protein, 4 aa, Human coronavirus
RLQI

SEQ ID NO: 687 - protein, 53 aa, Human coronavirus
KKVNQSAFLRLQLNKLTFLMRLLTTSGLLQLMKRSLSMKQKMLLNLCKKKHNQ

SEQ ID NO: 688 - protein, 11 aa, Human coronavirus
KYLLKILRRLS

SEQ ID NO: 689 - protein, 20 aa, Human coronavirus
LTPYRKLLLCLILLKSHRKW

SEQ ID NO: 690 - protein, 12 aa, Human coronavirus
NFRLHLRLSSPR

SEQ ID NO: 691 - protein, 46 aa, Human coronavirus
KKLHLSMRLIPNRHRMLLLNLRGYAKSVMLTLCPILNIRLLQSALP

SEQ ID NO: 692 - protein, 5 aa, Human coronavirus
VTQFK

SEQ ID NO: 693 - protein, 8 aa, Human coronavirus
PSAMGSLC

SEQ ID NO: 694 - protein, 41 aa, Human coronavirus
LMLLTHILSMAVVSLVLLMRLQKGLSKKSQMSIFWLKGRYK

SEQ ID NO: 695 - protein, 10 aa, Human coronavirus
EIQFSCKAIL

SEQ ID NO: 696 - protein, 7 aa, Human coronavirus
LRISCMS

SEQ ID NO: 697 - protein, 19 aa, Human coronavirus
AQMPALNRMFLSLVSAIRL

SEQ ID NO: 698 - protein, 5 aa, Human coronavirus
MHILL

SEQ ID NO: 699 - protein, 11 aa, Human coronavirus
SLLLFQQAYLV

SEQ ID NO: 700 - protein, 17 aa, Human coronavirus
NQLCLLIILLGRLRLEF

SEQ ID NO: 701 - protein, 13 aa, Human coronavirus
SSLIPKMSIRVLP

SEQ ID NO: 702 - protein, 6 aa, Human coronavirus
LTFHRV

SEQ ID NO: 703 - protein, 61 aa, Human coronavirus
LFHMMGYVAQYVKLKIMVLLFLCAQTTLLTLKFLGTRVLIILRSFLQLTVCNIIATRLRTL

SEQ ID NO: 704 - protein, 24 aa, Human coronavirus
MISYNRLISLLVLYLCLWDMCLMV

SEQ ID NO: 705 - protein, 17 aa, Human coronavirus
CKQGVSCVELTCPTCVS

SEQ ID NO: 706 - protein, 8 aa, Human coronavirus
LIKSKKLF

SEQ ID NO: 707 - protein, 6 aa, Human coronavirus
CLKTLS

SEQ ID NO: 708 - protein, 6 aa, Human coronavirus
TLQKIL

SEQ ID NO: 709 - protein, 13 aa, Human coronavirus
STSALMVVTILGI

SEQ ID NO: 710 - protein, 11 aa, Human coronavirus
SRVNYWCKTYA

SEQ ID NO: 711 - protein, 20 aa, Human coronavirus
ISSCIGLIKPYATRIVCFML

SEQ ID NO: 712 - protein, 25 aa, Human coronavirus
RIVQLFHLKHFQHVVRIWIHARHSS

SEQ ID NO: 713 - protein, 4 aa, Human coronavirus
QSKS

SEQ ID NO: 714 - protein, 4 aa, Human coronavirus
LSMV

SEQ ID NO: 715 - protein, 6 aa, Human coronavirus
ILEQSF

SEQ ID NO: 716 - protein, 35 aa, Human coronavirus
IIRTLIDHSLDAFSLMVLIFLTPFLMRNRMVTVYI

SEQ ID NO: 717 - protein, 45 aa, Human coronavirus
LLMKQRRLKSYMAPLILLSYTDSIHLRLQSMGGRWLCVIRYVLSN

SEQ ID NO: 718 - protein, 11 aa, Human coronavirus
VIIIVILMQLL

SEQ ID NO: 719 - protein, 4 aa, Human coronavirus
HLIY

SEQ ID NO: 720 - protein, 14 aa, Human coronavirus
RTLNLLYLLYSMHL

SEQ ID NO: 721 - protein, 10 aa, Human coronavirus
NIRAVIQLTS

SEQ ID NO: 722 - protein, 46 aa, Human coronavirus
PSLWLMAIAHLVLQMMPLGYFIPCLQRLSYAVLHAWFGESGAMSVA

SEQ ID NO: 723 - protein, 7 aa, Human coronavirus
KMLFYKA

SEQ ID NO: 724 - protein, 17 aa, Human coronavirus
KLVVTWVCKLLKICVLA

SEQ ID NO: 725 - protein, 13 aa, Human coronavirus
HMYASVVVNVIGN

SEQ ID NO: 726 - protein, 18 aa, Human coronavirus
SNTPPPGCCSQAHQMKNW

SEQ ID NO: 727 - protein, 8 aa, Human coronavirus
QPPRRLIL

SEQ ID NO: 728 - protein, 19 aa, Human coronavirus
HLMSFRALKRLLAIMFMLA

SEQ ID NO: 729 - protein, 5 aa, Human coronavirus
RVVLF

SEQ ID NO: 730 - protein, 16 aa, Human coronavirus
SLTLAPLARLQTGSAR

SEQ ID NO: 731 - protein, 49 aa, Human coronavirus
QMYFSPAKNTVAIVMSYGILWTVISEQRLIPTYLLSMLRMVNTLQVNHP

SEQ ID NO: 732 - protein, 7 aa, Human coronavirus
HIHQLQF

SEQ ID NO: 733 - protein, 23 aa, Human coronavirus
LVVSTLIAALYRLMDNLAVMLLV

SEQ ID NO: 734 - protein, 5 aa, Human coronavirus
VLITF

SEQ ID NO: 735 - protein, 72 aa, Human coronavirus
GLILVNQSLRNTLTPSCLKKTAMCCWLSLTLMTLFIRMVPCIKANQFFGSIKHLMILILISSIELVCVKFLT

SEQ ID NO: 736 - protein, 11 aa, Human coronavirus
PPLNSKINSHL

SEQ ID NO: 737 - protein, 11 aa, Human coronavirus
VWSLHQLNLQL

SEQ ID NO: 738 - protein, 5 aa, Human coronavirus
HFNRK

SEQ ID NO: 739 - protein, 7 aa, Human coronavirus
QLSNVRV

SEQ ID NO: 740 - protein, 4 aa, Human coronavirus
INLS

SEQ ID NO: 741 - protein, 28 aa, Human coronavirus
RTMSVSLLMIQVLPLLSICLKKTYIHCM

SEQ ID NO: 742 - protein, 8 aa, Human coronavirus
TLSIKSLS

SEQ ID NO: 743 - protein, 27 aa, Human coronavirus
KTMYFLLCLDCTPLSQVILTLLQLPDL

SEQ ID NO: 744 - protein, 23 aa, Human coronavirus
SYYLGLHFISKNLLPALSLLPLL

SEQ ID NO: 745 - protein, 6 aa, Human coronavirus
VLLKAY

SEQ ID NO: 746 - protein, 14 aa, Human coronavirus
QAVLVLPRCYLCFH

SEQ ID NO: 747 - protein, 14 aa, Human coronavirus
LTLVIQNSAPQRLK

SEQ ID NO: 748 - protein, 5 aa, Human coronavirus
KQPAL

SEQ ID NO: 749 - protein, 4 aa, Human coronavirus
QVML

SEQ ID NO: 750 - protein, 9 aa, Human coronavirus
NSVALLLLI

SEQ ID NO: 751 - protein, 51 aa, Human coronavirus
VWISCAVWIGNQPYGCYLCYAQLWYCCLLCITCMSSIRSYQVMLCLKMPKV

SEQ ID NO: 752 - protein, 10 aa, Human coronavirus
KSSTKKLELT

SEQ ID NO: 753 - protein, 34 aa, Human coronavirus
ESLLLVTVLLQLIGRIPLMYLHSAQTVLQCVIGA

SEQ ID NO: 754 - protein, 5 aa, Human coronavirus
LAKIP

SEQ ID NO: 755 - protein, 19 aa, Human coronavirus
LTTQLLRWFKHILATMFLT

SEQ ID NO: 756 - protein, 39 aa, Human coronavirus
IGCGLHLRLVWHTCSIPRPSTGCCWQVHCIISLHRLPYL

SEQ ID NO: 757 - protein, 30 aa, Human coronavirus
TGGHTIMLCLVPSGYSPTFQWRVWYECIIC

SEQ ID NO: 758 - protein, 12 aa, Human coronavirus
HAFGFYASFISM

SEQ ID NO: 759 - protein, 123 aa, Human coronavirus
SMVAKIRHACSAIRGTDLLELKLLPLSVVENVRFISQQMAVFHSVVGIIGIVWIVTLQVWGIPSSVKKSQMTSLPPYAGLLTLRIDHIIMWIPLQLKRLLFSLIIVETVNHSTSGFPSALLQI

SEQ ID NO: 760 - protein, 29 aa, Human coronavirus
SSKRSVKLLLVYLNTTLSSTTHQIVARKV

SEQ ID NO: 761 - protein, 66 aa, Human coronavirus
LGLHVFIILKSCVNQFFWLTQVWLLLLVILVKSPLKCLIPLLIVSSRCIMSHAISWKNLSLLLVMA

SEQ ID NO: 762 - protein, 9 aa, Human coronavirus
GEAITSIVS

SEQ ID NO: 763 - protein, 58 aa, Human coronavirus
QHSLTQHEAPQVWSLMLRPMKLLTLCSMLINMTYKLLMRATIIMYPHMLNLIVCLPAI

SEQ ID NO: 764 - protein, 30 aa, Human coronavirus
VVSLIVMRLQLTKLSCVILMVLAFGTLLHI

SEQ ID NO: 765 - protein, 18 aa, Human coronavirus
NSRMHLNDRFALHAVSVI

SEQ ID NO: 766 - protein, 36 aa, Human coronavirus
PPQSYALMIISYQLDSLLTKLLVVLLHGLMRCVTLR

SEQ ID NO: 767 - protein, 15 aa, Human coronavirus
RVMFLLPLLCFCVLY

SEQ ID NO: 768 - protein, 33 aa, Human coronavirus
CICVYLHFLWHLLNFMKTASWTLKFLIMVSLGM

SEQ ID NO: 769 - protein, 33 aa, Human coronavirus
ILMISALLISTGPSHNGIMSMLVVSMTTLSHAH

SEQ ID NO: 770 - protein, 18 aa, Human coronavirus
LLELLVLAFQTYLLHWLG

SEQ ID NO: 771 - protein, 18 aa, Human coronavirus
FSLFLESLLIQAVFATLL

SEQ ID NO: 772 - protein, 28 aa, Human coronavirus
MRYPIRVSLIVVAFFHLSALCLGMQRAV

SEQ ID NO: 773 - protein, 18 aa, Human coronavirus
HHTAMILLFCLGLLRTVR

SEQ ID NO: 774 - protein, 19 aa, Human coronavirus
GLMFVTTCMMVTCLLNFLK

SEQ ID NO: 775 - protein, 62 aa, Human coronavirus
YLKVHLGLLELCQLSTAGSVVVSMHKRVFVLPQMARGPFLMTTILIDLVSIVALILLTLSGG

SEQ ID NO: 776 - protein, 12 aa, Human coronavirus
QYHCSSLLLISN

SEQ ID NO: 777 - protein, 7 aa, Human coronavirus
LPHWSWV

SEQ ID NO: 778 - protein, 5 aa, Human coronavirus
VCVRS

SEQ ID NO: 779 - protein, 9 aa, Human coronavirus
LCSSIILIK

SEQ ID NO: 780 - protein, 11 aa, Human coronavirus
NVLLQITPSVL

SEQ ID NO: 781 - protein, 22 aa, Human coronavirus
LLLLLLFLIACASALLPLYHCV

SEQ ID NO: 782 - protein, 37 aa, Human coronavirus
YLTLHCTIMLHSILLMSLHLLCMFLGTLCSGLSFPYG

SEQ ID NO: 783 - protein, 16 aa, Human coronavirus
PASIQLQCALDTSSGF

SEQ ID NO: 784 - protein, 7 aa, Human coronavirus
LILVRNM

SEQ ID NO: 785 - protein, 33 aa, Human coronavirus
KFLLMVSLIVVSRTLPLISLLLTRTLMQLLETL

SEQ ID NO: 786 - protein, 57 aa, Human coronavirus
LMMPIHDFWGCLTSISTSLVLWKQPLIVKLQHVILLKPYKHTARLVVIFFTNHPTVA

SEQ ID NO: 787 - protein, 9 aa, Human coronavirus
PLACCKAVW

SEQ ID NO: 788 - protein, 20 aa, Human coronavirus
KCHIPVEMLRLVWFRLPAVA

SEQ ID NO: 789 - protein, 16 aa, Human coronavirus
LLMVFGLTTQSGAHDT

SEQ ID NO: 790 - protein, 15 aa, Human coronavirus
CARLTSCLILIMMPC

SEQ ID NO: 791 - protein, 28 aa, Human coronavirus
LIIVSVCKNTLALQQTCVLLVMPCKALF

SEQ ID NO: 792 - protein, 16 aa, Human coronavirus
LSMLLTLALQPTLLQQ

SEQ ID NO: 793 - protein, 8 aa, Human coronavirus
NLAQHLVC

SEQ ID NO: 794 - protein, 13 aa, Human coronavirus
HAIMVVRLVHSLL

SEQ ID NO: 795 - protein, 26 aa, Human coronavirus
CALTTQLRVPFCVVLVVVLVTPRRVV

SEQ ID NO: 796 - protein, 38 aa, Human coronavirus
SISVTCIKWNLLMVHIPVQHLMVLCMVPLWINKCTKFS

SEQ ID NO: 797 - protein, 8 aa, Human coronavirus
QTNTAVLM

SEQ ID NO: 798 - protein, 14 aa, Human coronavirus
LGFTQQYLMVALGL

SEQ ID NO: 799 - protein, 30 aa, Human coronavirus
NLIALVLFLLMNGLLPTNSLNLLALNPLTC

SEQ ID NO: 800 - protein, 54 aa, Human coronavirus
LSKQALLLNSCFMRSNNCILGSRESKSLAVPCWKMNSHLRMLICRLWVWLCRVV

SEQ ID NO: 801 - protein, 19 aa, Human coronavirus
EKLHMVLRIGCLRPLSQPM

SEQ ID NO: 802 - protein, 26 aa, Human coronavirus
SYKPLNLLCGTTCLRLFPHSCSHSYL

SEQ ID NO: 803 - protein, 15 aa, Human coronavirus
LWPSLCCWLNTNTPF

SEQ ID NO: 804 - protein, 10 aa, Human coronavirus
HFSCCLWLFV

SEQ ID NO: 805 - protein, 4 aa, Human coronavirus
LMQT

SEQ ID NO: 806 - protein, 11 aa, Human coronavirus
STSPLLPFRQR

SEQ ID NO: 807 - protein, 30 aa, Human coronavirus
LQLQIGLPPLMLICALHILILVSTLVCHLY

SEQ ID NO: 808 - protein, 12 aa, Human coronavirus
RDCTTHHFLTLR

SEQ ID NO: 809 - protein, 5 aa, Human coronavirus
HCAVV

SEQ ID NO: 810 - protein, 59 aa, Human coronavirus
CGCTLIALEKPQAPLPIWFLSLHSLVIIRLQSLLLSTLQKFALMPSLLTHHSLHLCFRK

SEQ ID NO: 811 - protein, 7 aa, Human coronavirus
YFYYTHV

SEQ ID NO: 812 - protein, 13 aa, Human coronavirus
VSCVLAILVSSLF

SEQ ID NO: 813 - protein, 22 aa, Human coronavirus
TLSLEHLWVSMTLRSQHKSSDS

SEQ ID NO: 814 - protein, 4 aa, Human coronavirus
LLTI

SEQ ID NO: 815 - protein, 11 aa, Human coronavirus
LHLEILGRLWL

SEQ ID NO: 816 - protein, 7 aa, Human coronavirus
VLAVHLV

SEQ ID NO: 817 - protein, 27 aa, Human coronavirus
RLLLCSLNLQILNAHLWFSSLCSNSYT

SEQ ID NO: 818 - protein, 30 aa, Human coronavirus
RLIVGPGLSVLNAIMIYWQQQTPVRLSRNS

SEQ ID NO: 819 - protein, 5 aa, Human coronavirus
VSLLL

SEQ ID NO: 820 - protein, 5 aa, Human coronavirus
LFLVM

SEQ ID NO: 821 - protein, 4 aa, Human coronavirus
ILMR

SEQ ID NO: 822 - protein, 20 aa, Human coronavirus
LVIFLTLLAYFKLLFLSFHT

SEQ ID NO: 823 - protein, 35 aa, Human coronavirus
LPLLSWKLRRKPIRKLWTLVTPHHKFLRLCRRLLI

SEQ ID NO: 824 - protein, 14 aa, Human coronavirus
LKTPMRRIRQWPVS

SEQ ID NO: 825 - protein, 7 aa, Human coronavirus
NVWLIRL

SEQ ID NO: 826 - protein, 26 aa, Human coronavirus
LLCISKHVLKTRKQKLSVLCKLCCLV

SEQ ID NO: 827 - protein, 36 aa, Human coronavirus
LRSSTTMFLMVSFLTLGMVVYLLVSSHCVLQINFAL

SEQ ID NO: 828 - protein, 9 aa, Human coronavirus
FLTSPSGIR

SEQ ID NO: 829 - protein, 17 aa, Human coronavirus
SHIPRLTTLGLCGTLQL

SEQ ID NO: 830 - protein, 13 aa, Human coronavirus
TMWTMKLLSLQML

SEQ ID NO: 831 - protein, 5 aa, Human coronavirus
TAMKI

SEQ ID NO: 832 - protein, 5 aa, Human coronavirus
HGHLF

SEQ ID NO: 833 - protein, 21 aa, Human coronavirus
NALGHPLLPLSCKIMRSNLQV

SEQ ID NO: 834 - protein, 18 aa, Human coronavirus
KPWLCLRVKSKLTVILVP

SEQ ID NO: 835 - protein, 11 aa, Human coronavirus
LITNLCRVVKC

SEQ ID NO: 836 - protein, 23 aa, Human coronavirus
WLFFLIMPISNGRVLKVRTDLSV

SEQ ID NO: 837 - protein, 8 aa, Human coronavirus
SYNLLANS

SEQ ID NO: 838 - protein, 26 aa, Human coronavirus
LRDQKDLKSDISILLKILTTFIAGKC

SEQ ID NO: 839 - protein, 47 aa, Human coronavirus
GTLLRLLDCKLVLTPSLPLIPRCCHLLTSPLILKKLISISSMREVPH

SEQ ID NO: 840 - protein, 14 aa, Human coronavirus
QIVLRCLLLKLVQV

SEQ ID NO: 841 - protein, 27 aa, Human coronavirus
LYLLNQRVQLIKRLMVELQCVSIAVRI

SEQ ID NO: 842 - protein, 65 aa, Human coronavirus
NILMSLVFVNIRVSLSKSLLSVSVTLWDFVCQIPPVMSVNIGLDMGAIVTRLGKQHCPNLKIPIF

SEQ ID NO: 843 - protein, 20 aa, Human coronavirus
TSPGFYCKCPNRTLFKWFVH

SEQ ID NO: 844 - protein, 4 aa, Human coronavirus
HLQL

SEQ ID NO: 845 - protein, 10 aa, Human coronavirus
GCWYWKILQD

SEQ ID NO: 846 - protein, 5 aa, Human coronavirus
VCRIR

SEQ ID NO: 847 - protein, 11 aa, Human coronavirus
PRASFRLLFCR

SEQ ID NO: 848 - protein, 7 aa, Human coronavirus
EAYYGEL

SEQ ID NO: 849 - protein, 10 aa, Human coronavirus
TREALLRLVT

SEQ ID NO: 850 - protein, 5 aa, Human coronavirus
CCSSP

SEQ ID NO: 851 - protein, 4 aa, Human coronavirus
FLHL

SEQ ID NO: 852 - protein, 4 aa, Human coronavirus
CRQS

SEQ ID NO: 853 - protein, 10 aa, Human coronavirus
NTSYCTSAFN

SEQ ID NO: 854 - protein, 13 aa, Human coronavirus
VHYDGSCICPEAL

SEQ ID NO: 855 - protein, 9 aa, Human coronavirus
GYLSEVWLL

SEQ ID NO: 856 - protein, 4 aa, Human coronavirus
CYLL

SEQ ID NO: 857 - protein, 9 aa, Human coronavirus
KSQCYWCLS

SEQ ID NO: 858 - protein, 13 aa, Human coronavirus
TWRTCTPSYLKHC

SEQ ID NO: 859 - protein, 18 aa, Human coronavirus
PHGQGWFSRCAHTRQPGP

SEQ ID NO: 860 - protein, 4 aa, Human coronavirus
WQVV

SEQ ID NO: 861 - protein, 13 aa, Human coronavirus
LRNHSTWFRSSYS

SEQ ID NO: 862 - protein, 17 aa, Human coronavirus
LLFLFDACALNDRLSGR

SEQ ID NO: 863 - protein, 4 aa, Human coronavirus
VATY

SEQ ID NO: 864 - protein, 4 aa, Human coronavirus
GTTL

SEQ ID NO: 865 - protein, 11 aa, Human coronavirus
ILGSDVSRKLR

SEQ ID NO: 866 - protein, 7 aa, Human coronavirus
PLCVTLC

SEQ ID NO: 867 - protein, 10 aa, Human coronavirus
FQCIVCYDHA

SEQ ID NO: 868 - protein, 12 aa, Human coronavirus
DLFRTHSPKDLC

SEQ ID NO: 869 - protein, 23 aa, Human coronavirus
WRAICSILWLSLQRIRFSHEYGC

SEQ ID NO: 870 - protein, 7 aa, Human coronavirus
GVDDVCR

SEQ ID NO: 871 - protein, 8 aa, Human coronavirus
SSHAHCLL

SEQ ID NO: 872 - protein, 6 aa, Human coronavirus
FEDIMF

SEQ ID NO: 873 - protein, 18 aa, Human coronavirus
CRCTYNWFDFSNCAAWQF

SEQ ID NO: 874 - protein, 4 aa, Human coronavirus
PRLL

SEQ ID NO: 875 - protein, 4 aa, Human coronavirus
FRGI

SEQ ID NO: 876 - protein, 16 aa, Human coronavirus
GGLFSDAQTFFLCSRW

SEQ ID NO: 877 - protein, 6 aa, Human coronavirus
CCYYRL

SEQ ID NO: 878 - protein, 4 aa, Human coronavirus
LLFL

SEQ ID NO: 879 - protein, 5 aa, Human coronavirus
SAYYV

SEQ ID NO: 880 - protein, 18 aa, Human coronavirus
HQTNVVLHGSCKQVLRNL

SEQ ID NO: 881 - protein, 4 aa, Human coronavirus
RWLS

SEQ ID NO: 882 - protein, 9 aa, Human coronavirus
FRQECWPSF

SEQ ID NO: 883 - protein, 8 aa, Human coronavirus
VWQSSCLL

SEQ ID NO: 884 - protein, 8 aa, Human coronavirus
EHVLPGAR

SEQ ID NO: 885 - protein, 7 aa, Human coronavirus
TFCHDKA

SEQ ID NO: 886 - protein, 14 aa, Human coronavirus
RHSYHDSNESKICY

SEQ ID NO: 887 - protein, 10 aa, Human coronavirus
SSHCCRRVHT

SEQ ID NO: 888 - protein, 8 aa, Human coronavirus
SPVPSENA

SEQ ID NO: 889 - protein, 25 aa, Human coronavirus
VHGCNSWSDLRHWYYKVLRWLGFHA

SEQ ID NO: 890 - protein, 6 aa, Human coronavirus
NIVQRC

SEQ ID NO: 891 - protein, 9 aa, Human coronavirus
SASYGLGLP

SEQ ID NO: 892 - protein, 9 aa, Human coronavirus
NLRFTHISS

SEQ ID NO: 893 - protein, 16 aa, Human coronavirus
TWHLLYYKGQILSLGK

SEQ ID NO: 894 - protein, 23 aa, Human coronavirus
VCSGAKRICSMWWWLLRQTWRYQ

SEQ ID NO: 895 - protein, 9 aa, Human coronavirus
RRCHHCICQ

SEQ ID NO: 896 - protein, 7 aa, Human coronavirus
HFAGDNC

SEQ ID NO: 897 - protein, 7 aa, Human coronavirus
CQCTYGC

SEQ ID NO: 898 - protein, 5 aa, Human coronavirus
WQQDC

SEQ ID NO: 899 - protein, 4 aa, Human coronavirus
RHAV

SEQ ID NO: 900 - protein, 9 aa, Human coronavirus
FVCQCLQEH

SEQ ID NO: 901 - protein, 6 aa, Human coronavirus
PRPQIC

SEQ ID NO: 902 - protein, 5 aa, Human coronavirus
ILCFS

SEQ ID NO: 903 - protein, 8 aa, Human coronavirus
ALFYDDTV

SEQ ID NO: 904 - protein, 5 aa, Human coronavirus
RCRLL

SEQ ID NO: 905 - protein, 9 aa, Human coronavirus
GLHCWNTEF

SEQ ID NO: 906 - protein, 12 aa, Human coronavirus
GNAVLSEQCLYV

SEQ ID NO: 907 - protein, 12 aa, Human coronavirus
MLGGNRSEERAT

SEQ ID NO: 908 - protein, 9 aa, Human coronavirus
ILFTAYALY

SEQ ID NO: 909 - protein, 24 aa, Human coronavirus
GWRRWLLPSLSRPFKNFVCRLLCR

SEQ ID NO: 910 - protein, 21 aa, Human coronavirus
RYTHGRAVCVFGYRCLPSHKA

SEQ ID NO: 911 - protein, 19 aa, Human coronavirus
RYRIPECILGLLTVYRKTV

SEQ ID NO: 912 - protein, 7 aa, Human coronavirus
RPYRTHA

SEQ ID NO: 913 - protein, 8 aa, Human coronavirus
QLFCHAMW

SEQ ID NO: 914 - protein, 7 aa, Human coronavirus
VLGRGIL

SEQ ID NO: 915 - protein, 27 aa, Human coronavirus
FAYHFAGCRFMRCMPFTDFPTLWDMHP

SEQ ID NO: 916 - protein, 5 aa, Human coronavirus
TISLL

SEQ ID NO: 917 - protein, 7 aa, Human coronavirus
SCYSNST

SEQ ID NO: 918 - protein, 10 aa, Human coronavirus
DGFVCFSLRL

SEQ ID NO: 919 - protein, 10 aa, Human coronavirus
CPWLWRFRRY

SEQ ID NO: 920 - protein, 13 aa, Human coronavirus
AIFRWYELLLCRS

SEQ ID NO: 921 - protein, 5 aa, Human coronavirus
FSTLR

SEQ ID NO: 922 - protein, 13 aa, Human coronavirus
WSCIRLIQEYVHR

SEQ ID NO: 923 - protein, 4 aa, Human coronavirus
SFYS

SEQ ID NO: 924 - protein, 4 aa, Human coronavirus
VGYL

SEQ ID NO: 925 - protein, 16 aa, Human coronavirus
LHPCQYYNRTTQTFCC

SEQ ID NO: 926 - protein, 5 aa, Human coronavirus
DFTCH

SEQ ID NO: 927 - protein, 13 aa, Human coronavirus
AVLCYCHHQRNCW

SEQ ID NO: 928 - protein, 18 aa, Human coronavirus
APTITCVGGWQVQTTTQS

SEQ ID NO: 929 - protein, 11 aa, Human coronavirus
LCFYWLSYNQK

SEQ ID NO: 930 - protein, 4 aa, Human coronavirus
SAAR

SEQ ID NO: 931 - protein, 6 aa, Human coronavirus
VHFRAH

SEQ ID NO: 932 - protein, 6 aa, Human coronavirus
CCILQV

SEQ ID NO: 933 - protein, 4 aa, Human coronavirus
TDCR

SEQ ID NO: 934 - protein, 24 aa, Human coronavirus
HLRTYLSLCGYLDGAHNCESREVC

SEQ ID NO: 935 - protein, 11 aa, Human coronavirus
NYWVVPNHYGT

SEQ ID NO: 936 - protein, 14 aa, Human coronavirus
RVRKSCCQLPKIRL

SEQ ID NO: 937 - protein, 38 aa, Human coronavirus
ICHCSGTTWHWQKSFCYRVSDLLPYSTCCLYSMFTRSC

SEQ ID NO: 938 - protein, 5 aa, Human coronavirus
IFEHC

SEQ ID NO: 939 - protein, 11 aa, Human coronavirus
MFPYHSCKGTC

SEQ ID NO: 940 - protein, 7 aa, Human coronavirus
DKFSIFV

SEQ ID NO: 941 - protein, 12 aa, Human coronavirus
CSTRNFCRYSGG

SEQ ID NO: 942 - protein, 4 aa, Human coronavirus
SFNY

SEQ ID NO: 943 - protein, 14 aa, Human coronavirus
AHCLCRRSSTVASS

SEQ ID NO: 944 - protein, 4 aa, Human coronavirus
DFVD

SEQ ID NO: 945 - protein, 9 aa, Human coronavirus
RHIGTRKFQ

SEQ ID NO: 946 - protein, 10 aa, Human coronavirus
HIFKYVLQVS

SEQ ID NO: 947 - protein, 12 aa, Human coronavirus
GNSKHCERSCLQ

SEQ ID NO: 948 - protein, 12 aa, Human coronavirus
IVSQEGAFRPVL

SEQ ID NO: 949 - protein, 5 aa, Human coronavirus
GQCDA

SEQ ID NO: 950 - protein, 17 aa, Human coronavirus
TTTHICEEFYYCQSGME

SEQ ID NO: 951 - protein, 25 aa, Human coronavirus
GSLYFALQFTECCVSFNAGSYHSDC

SEQ ID NO: 952 - protein, 21 aa, Human coronavirus
FLTGFRIPVRYLLSNSRYGTC

SEQ ID NO: 953 - protein, 20 aa, Human coronavirus
CCNHSCPKRYSLCYDISGTL

SEQ ID NO: 954 - protein, 5 aa, Human coronavirus
VLRVY

SEQ ID NO: 955 - protein, 4 aa, Human coronavirus
IVFY

SEQ ID NO: 956 - protein, 12 aa, Human coronavirus
LQAPVSDCNWPF

SEQ ID NO: 957 - protein, 14 aa, Human coronavirus
RNFWPLTCLCTNIC

SEQ ID NO: 958 - protein, 5 aa, Human coronavirus
ALRES

SEQ ID NO: 959 - protein, 16 aa, Human coronavirus
FTRKCPILSCYFQDGL

SEQ ID NO: 960 - protein, 9 aa, Human coronavirus
TRCNSSWIS

SEQ ID NO: 961 - protein, 5 aa, Human coronavirus
AFHYS

SEQ ID NO: 962 - protein, 14 aa, Human coronavirus
RGCKASSKLDRLRC

SEQ ID NO: 963 - protein, 6 aa, Human coronavirus
GCSCFP

SEQ ID NO: 964 - protein, 28 aa, Human coronavirus
CMWHQCASTIRIFNWCELCCSASWCCRH

SEQ ID NO: 965 - protein, 12 aa, Human coronavirus
HVNGHCCTSSTR

SEQ ID NO: 966 - protein, 7 aa, Human coronavirus
APRASYA

SEQ ID NO: 967 - protein, 7 aa, Human coronavirus
GGCVAYC

SEQ ID NO: 968 - protein, 15 aa, Human coronavirus
TTYSANVVRHFRQIV

SEQ ID NO: 969 - protein, 11 aa, Human coronavirus
LLYVCLLGSWL

SEQ ID NO: 970 - protein, 11 aa, Human coronavirus
INVCIILLQDR

SEQ ID NO: 971 - protein, 8 aa, Human coronavirus
GTEVLHVQ

SEQ ID NO: 972 - protein, 21 aa, Human coronavirus
TRCSVLFTSAILCLLDSFLRL

SEQ ID NO: 973 - protein, 21 aa, Human coronavirus
LCLQPFLCRCSTVGLCRQSCY

SEQ ID NO: 974 - protein, 15 aa, Human coronavirus
SRSLLLCPSRSSCGF

SEQ ID NO: 975 - protein, 28 aa, Human coronavirus
CNNDSLFSYSFLFYRTCGLGYRVSLYLT

SEQ ID NO: 976 - protein, 7 aa, Human coronavirus
KEIEFLL

SEQ ID NO: 977 - protein, 13 aa, Human coronavirus
AQRRTCCSSCRFI

SEQ ID NO: 978 - protein, 4 aa, Human coronavirus
YWQS

SEQ ID NO: 979 - protein, 5 aa, Human coronavirus
RNSYC

SEQ ID NO: 980 - protein, 4 aa, Human coronavirus
LALF

SEQ ID NO: 981 - protein, 22 aa, Human coronavirus
CTALDQEGTTAFLYRGHGLKIC

SEQ ID NO: 982 - protein, 8 aa, Human coronavirus
WALLILEL

SEQ ID NO: 983 - protein, 5 aa, Human coronavirus
CTKIS

SEQ ID NO: 984 - protein, 6 aa, Human coronavirus
CNCMQV

SEQ ID NO: 985 - protein, 5 aa, Human coronavirus
HTCAF

SEQ ID NO: 986 - protein, 6 aa, Human coronavirus
VQFARL

SEQ ID NO: 987 - protein, 9 aa, Human coronavirus
QARFSYTSI

SEQ ID NO: 988 - protein, 5 aa, Human coronavirus
CECIP

SEQ ID NO: 989 - protein, 14 aa, Human coronavirus
SETFTILLLFYYTM

SEQ ID NO: 990 - protein, 5 aa, Human coronavirus
YDRGY

SEQ ID NO: 991 - protein, 13 aa, Human coronavirus
LCTPKICSLYYSL

SEQ ID NO: 992 - protein, 6 aa, Human coronavirus
FRGRCL

SEQ ID NO: 993 - protein, 13 aa, Human coronavirus
EACYRVQRVYGSI

SEQ ID NO: 994 - protein, 12 aa, Human coronavirus
SCLCIRFPPLVL

SEQ ID NO: 995 - protein, 16 aa, Human coronavirus
SLVYFYKSSRFGKHCF

SEQ ID NO: 996 - protein, 7 aa, Human coronavirus
TRPFYWC

SEQ ID NO: 997 - protein, 7 aa, Human coronavirus
TTCSCSQ

SEQ ID NO: 998 - protein, 7 aa, Human coronavirus
DLHQEWR

SEQ ID NO: 999 - protein, 4 aa, Human coronavirus
HLYV

SEQ ID NO: 1000 - protein, 5 aa, Human coronavirus
NHFAY

SEQ ID NO: 1001 - protein, 28 aa, Human coronavirus
ACCTLASRFQIATQFTSRHLLQVRPLGL

SEQ ID NO: 1002 - protein, 11 aa, Human coronavirus
QYLWYCYYWCM

SEQ ID NO: 1003 - protein, 7 aa, Human coronavirus
FSFEYMF

SEQ ID NO: 1004 - protein, 16 aa, Human coronavirus
LFIGEVHVYSQCHLYF

SEQ ID NO: 1005 - protein, 11 aa, Human coronavirus
KNQEIPLYGRS

SEQ ID NO: 1006 - protein, 10 aa, Human coronavirus
LCLLQWCYHP

SEQ ID NO: 1007 - protein, 8 aa, Human coronavirus
TTSEVLLV

SEQ ID NO: 1008 - protein, 9 aa, Human coronavirus
VYLHSESLL

SEQ ID NO: 1009 - protein, 5 aa, Human coronavirus
LPTPF

SEQ ID NO: 1010 - protein, 8 aa, Human coronavirus
HGERLSIF

SEQ ID NO: 1011 - protein, 9 aa, Human coronavirus
EVWLGKLCF

SEQ ID NO: 1012 - protein, 38 aa, Human coronavirus
ARSLWRLLSYYVRRSSLAYWFIQEATGRSYYYGRNAKR

SEQ ID NO: 1013 - protein, 4 aa, Human coronavirus
LNYS

SEQ ID NO: 1014 - protein, 4 aa, Human coronavirus
LFYY

SEQ ID NO: 1015 - protein, 4 aa, Human coronavirus
HSGF

SEQ ID NO: 1016 - protein, 10 aa, Human coronavirus
GGVFCYRFKA

SEQ ID NO: 1017 - protein, 22 aa, Human coronavirus
RLCYDFKESRPWRSIQGCQGSY

SEQ ID NO: 1018 - protein, 4 aa, Human coronavirus
LNND

SEQ ID NO: 1019 - protein, 5 aa, Human coronavirus
VYVMV

SEQ ID NO: 1020 - protein, 27 aa, Human coronavirus
GWTGSNLLPSTPGFCRLETWSCNAIPL

SEQ ID NO: 1021 - protein, 6 aa, Human coronavirus
SSKCKP

SEQ ID NO: 1022 - protein, 16 aa, Human coronavirus
LQAIYSYASRCAHEHR

SEQ ID NO: 1023 - protein, 28 aa, Human coronavirus
IYAIVPVFKYLHISRACQYACYTFWRWF

SEQ ID NO: 1024 - protein, 21 aa, Human coronavirus
RYRSWYLSFTTVASYRCHYYR

SEQ ID NO: 1025 - protein, 5 aa, Human coronavirus
VRVRC

SEQ ID NO: 1026 - protein, 24 aa, Human coronavirus
HNFIWRLCNCTCRPTSGSCYFRHV

SEQ ID NO: 1027 - protein, 4 aa, Human coronavirus
ECNR

SEQ ID NO: 1028 - protein, 10 aa, Human coronavirus
VKGFILYLPV

SEQ ID NO: 1029 - protein, 9 aa, Human coronavirus
SCSWWVCCY

SEQ ID NO: 1030 - protein, 8 aa, Human coronavirus
NNRTLLER

SEQ ID NO: 1031 - protein, 20 aa, Human coronavirus
TYGKICLVDCFLHQCKCILI

SEQ ID NO: 1032 - protein, 6 aa, Human coronavirus
RIPLRY

SEQ ID NO: 1033 - protein, 5 aa, Human coronavirus
LLGYY

SEQ ID NO: 1034 - protein, 29 aa, Human coronavirus
RKYRWWCYARQLYILEKFHSYESEYLLTF

SEQ ID NO: 1035 - protein, 21 aa, Human coronavirus
FIQVSIKIKRNTSSSIKGESN

SEQ ID NO: 1036 - protein, 10 aa, Human coronavirus
RTRNISPVAG

SEQ ID NO: 1037 - protein, 4 aa, Human coronavirus
VTYP

SEQ ID NO: 1038 - protein, 6 aa, Human coronavirus
YTQCFY

SEQ ID NO: 1039 - protein, 8 aa, Human coronavirus
HLQKVTLM

SEQ ID NO: 1040 - protein, 45 aa, Human coronavirus
GQILLSLLVLRLIYNRLSLIKLGLGQLMFLRLTVLYTLKAVHILT

SEQ ID NO: 1041 - protein, 34 aa, Human coronavirus
LSLIKVFFPIRETMVICMFTLQDMLQAQLHKSCL

SEQ ID NO: 1042 - protein, 17 aa, Human coronavirus
LTILRTSNSLLMGLSSV

SEQ ID NO: 1043 - protein, 48 aa, Human coronavirus
EQLPIPLALLLLAHLPALLYEKFTLLLCWVLQLVISQMVKWAASSIIL

SEQ ID NO: 1044 - protein, 17 aa, Human coronavirus
FFCPMDVALYLELFIVF

SEQ ID NO: 1045 - protein, 37 aa, Human coronavirus
SLALEIIVLLAIPILLLPLITLLQQIVLMAITIVMPV

SEQ ID NO: 1046 - protein, 25 aa, Human coronavirus
TLLRSILIYVTAPLCTLITLPKMRF

SEQ ID NO: 1047 - protein, 69 aa, Human coronavirus
SGLALHKLLKVFTSSHLGMLICTAAICFNLPPCLFMILLSIILSFLTVFVLSKVIEKLGLPSTYINFNR

SEQ ID NO: 1048 - protein, 15 aa, Human coronavirus
LSCWIFLLMVIYAEL

SEQ ID NO: 1049 - protein, 82 aa, Human coronavirus
TVVLMICHNSTAHMNPSMLNLEFIQFRLSKQNLLAQLWNRLKVLNVIFHLFCLAHLLRFIISSVWFLPIAIIILPNCFHFFL

SEQ ID NO: 1050 - protein, 20 aa, Human coronavirus
MILLVVKYLQQQLLATVILH

SEQ ID NO: 1051 - protein, 10 aa, Human coronavirus
FWITFHTHLV

SEQ ID NO: 1052 - protein, 26 aa, Human coronavirus
NPISVLVLLVQYPSLIINSPFLIPHV

SEQ ID NO: 1053 - protein, 35 aa, Human coronavirus
RLFLITLLLLLSLLSTAILTSALVFFLMIVLKYLS

SEQ ID NO: 1054 - protein, 44 aa, Human coronavirus
TLINTHPVYPLSHPLCGKTVIIIGNNYLHLKVVAGLLLVAQLLP

SEQ ID NO: 1055 - protein, 36 aa, Human coronavirus
LSNYRWALVLQFNMVQTPIVFAPSLNLLMTQKLPLN

SEQ ID NO: 1056 - protein, 22 aa, Human coronavirus
AIAWNIPSMVFRAVVFFRIAQL

SEQ ID NO: 1057 - protein, 14 aa, Human coronavirus
VFDSSALFMMRTRI

SEQ ID NO: 1058 - protein, 76 aa, Human coronavirus
LAIILMMATTTVCVLVLVFLFLSSMIKKLKPTLLYLVVLHVNTFLLPCLNTPVLRDQCLNGEILHMAPFRHLLVVS

SEQ ID NO: 1059 - protein, 8 aa, Human coronavirus
DLLIPLCS

SEQ ID NO: 1060 - protein, 55 aa, Human coronavirus
RTASCLLVNLSVLFLTHLVLSHLAVCALFQVKCAWHPLLLIILFRLINLIVVILN

SEQ ID NO: 1061 - protein, 9 aa, Human coronavirus
VYPLIFPLV

SEQ ID NO: 1062 - protein, 40 aa, Human coronavirus
LRSTFRQPFRKLLLIVNSTFAMVSRSVSNYCASMASFVPK

SEQ ID NO: 1063 - protein, 21 aa, Human coronavirus
TRLSMVPIYARMILYVICLRA

SEQ ID NO: 1064 - protein, 17 aa, Human coronavirus
KALNHLLSYQVLEVTLI

SEQ ID NO: 1065 - protein, 25 aa, Human coronavirus
NLFLYLLAVVVHVVLLRICYLTKSL

SEQ ID NO: 1066 - protein, 54 aa, Human coronavirus
LILVICKVTMIACSKVQHQLVILFVLNMWLVTKYYLLLWMLIWKPRILHLCLAA

SEQ ID NO: 1067 - protein, 24 aa, Human coronavirus
QVLAGLLAYPPLLLFHLHRVSFIG

SEQ ID NO: 1068 - protein, 45 aa, Human coronavirus
TVLALLNRFFQRTKSLLPISLIRLWELCKQASLQLMKLFRRFRML

SEQ ID NO: 1069 - protein, 9 aa, Human coronavirus
TTMHRLYPN

SEQ ID NO: 1070 - protein, 30 aa, Human coronavirus
LASYLILLVLFPPLLETSYNVLMFSNRTPK

SEQ ID NO: 1071 - protein, 7 aa, Human coronavirus
TDLLMAV

SEQ ID NO: 1072 - protein, 44 aa, Human coronavirus
MLLLHSSLFVPNQLLFPLNWLKIKSMSVSRHNPSVLDFAVKAHI

SEQ ID NO: 1073 - protein, 4 aa, Human coronavirus
CPLL

SEQ ID NO: 1074 - protein, 36 aa, Human coronavirus
MPLMAFTSCMLVITLATTLRLFLLMVFAMQLTLLIV

SEQ ID NO: 1075 - protein, 43 aa, Human coronavirus
PLLMATLLKLITLGLLMSGHILARPSMHLSPLPPLILSMLHHR

SEQ ID NO: 1076 - protein, 42 aa, Human coronavirus
HTKTFLLTSLLLFSAIPPGLTSKMSWMSFSKMLAPVYLILVP

SEQ ID NO: 1077 - protein, 28 aa, Human coronavirus
HRLILHYSILPTRCCLFNKLLKPLMSLT

SEQ ID NO: 1078 - protein, 28 aa, Human coronavirus
TLKSLAIILITTNGRGTFGLVSLLGLLP

SEQ ID NO: 1079 - protein, 44 aa, Human coronavirus
LYASSSYCAALVVAQTVWENLSVIVVVIDTRNTTSSRIRFMFTN

SEQ ID NO: 1080 - protein, 32 aa, Human coronavirus
RTINESSKTTHSLVSVFTLSFGHCILKTSLCT

SEQ ID NO: 1081 - protein, 10 aa, Human coronavirus
ALSELFWLHA

SEQ ID NO: 1082 - protein, 4 aa, Human coronavirus
NCPS

SEQ ID NO: 1083 - protein, 10 aa, Human coronavirus
YSWSLYKFSN

SEQ ID NO: 1084 - protein, 16 aa, Human coronavirus
RPICRINWYSISFCRS

SEQ ID NO: 1085 - protein, 5 aa, Human coronavirus
VNFNS

SEQ ID NO: 1086 - protein, 7 aa, Human coronavirus
WSYRTCY

SEQ ID NO: 1087 - protein, 4 aa, Human coronavirus
CESF

SEQ ID NO: 1088 - protein, 5 aa, Human coronavirus
RWLLS

SEQ ID NO: 1089 - protein, 113 aa, Human coronavirus
LTNSMDYVSLLNQIWQKYLNSPYTTCLYIPKPTAKYTPLVGTSLHPVLWNCQLSFAGYTESAVNSTKALAKQDAAQRIAWLLHKDGGIPDGCSLYLRHSSLFAQSEEEEPFSN

SEQ ID NO: 1090 - protein, 5 aa, Human coronavirus
ETALR

SEQ ID NO: 1091 - protein, 6 aa, Human coronavirus
IFSSAP

SEQ ID NO: 1092 - protein, 34 aa, Human coronavirus
CYCPTNTLCQGYIFRPQHVVSTFGSSFTLSSQLA

SEQ ID NO: 1093 - protein, 8 aa, Human coronavirus
TLWRPTCF

SEQ ID NO: 1094 - protein, 11 aa, Human coronavirus
VPYYSSFAKSH

SEQ ID NO: 1095 - protein, 14 aa, Human coronavirus
RFFTHCALFAQCQI

SEQ ID NO: 1096 - protein, 10 aa, Human coronavirus
VRLAAQNSCS

SEQ ID NO: 1097 - protein, 7 aa, Human coronavirus
CIRDLLC

SEQ ID NO: 1098 - protein, 6 aa, Human coronavirus
HGNPYY

SEQ ID NO: 1099 - protein, 12 aa, Human coronavirus
GLASRSGIFPLP

SEQ ID NO: 1100 - protein, 9 aa, Human coronavirus
WPPFTYVNL

SEQ ID NO: 1101 - protein, 5 aa, Human coronavirus
IACTG

SEQ ID NO: 1102 - protein, 12 aa, Human coronavirus
CYSQLHHYNAML

SEQ ID NO: 1103 - protein, 24 aa, Human coronavirus
NLPSTNVCYSFGRRCCLHTVFQSG

SEQ ID NO: 1104 - protein, 25 aa, Human coronavirus
TNCSFLSHFTSSRILTNYGFLGVFI

SEQ ID NO: 1105 - protein, 14 aa, Human coronavirus
TRPASPSFSCISSH

SEQ ID NO: 1106 - protein, 9 aa, Human coronavirus
LYCFHIHSC

SEQ ID NO: 1107 - protein, 40 aa, Human coronavirus
RLCSCFSCQCVSHSPIITATSRYLSSQHYQNYGSLFPCSV

SEQ ID NO: 1108 - protein, 33 aa, Human coronavirus
LFISHCTSQWCTLSNWKLPDSLLSYPHNTLVCR

SEQ ID NO: 1109 - protein, 14 aa, Human coronavirus
NSFLSHAEFLHSTV

SEQ ID NO: 1110 - protein, 8 aa, Human coronavirus
HAFPLYSC

SEQ ID NO: 1111 - protein, 18 aa, Human coronavirus
YSFFSWYGPCNTHQTIIY

SEQ ID NO: 1112 - protein, 25 aa, Human coronavirus
KLRSALQLFSLFLFALFHLYRVHLY

SEQ ID NO: 1113 - protein, 5 aa, Human coronavirus
PSFCN

SEQ ID NO: 1114 - protein, 44 aa, Human coronavirus
LLLKRQCFHCFRACNARFSSSSHNRPELAYRLSSSALLWVPCRG

SEQ ID NO: 1115 - protein, 49 aa, Human coronavirus
SISLSLDIWKTNYVTLCPRTNRVVHSKLFHFYRSMCYNTLGVYGFPYGY

SEQ ID NO: 1116 - protein, 21 aa, Human coronavirus
IMCAMYDRLQYPVSSARIILV

SEQ ID NO: 1117 - protein, 11 aa, Human coronavirus
YWTFSLCKIPG

SEQ ID NO: 1118 - protein, 5 aa, Human coronavirus
TPSTT

SEQ ID NO: 1119 - protein, 228 aa, Human coronavirus
RVGLTNSFIMSNMTQLTEAQIIAIIKDWNFAWSLIFLLITIVLQYGYPSRSMTVYVFKMFVLWLLWPSSMALSIFSAVYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 1120 - protein, 4 aa, Human coronavirus
EYLN

SEQ ID NO: 1121 - protein, 24 aa, Human coronavirus
RISISLLWHPLLHLVLFPLPITMI

SEQ ID NO: 1122 - protein, 159 aa, Human coronavirus
QIQTYLEVEDVIQNHELHQITLSLGTLGLPNTGKSLLPFHLGRVYLLMPILPLRKMLGIGGDRTEKLIPGMELSNWLPGGTSTTLELDPKQHSHSGLLRMASFGSMKMAPLMLLQLLGRGTLTMIQLLLHNSRPVLSFLKTSTLRGLEAIVNHLQEPLA

SEQ ID NO: 1123 - protein, 30 aa, Human coronavirus
AETLPDLVHKVQDQETLPAALLQVHLESEQ

SEQ ID NO: 1124 - protein, 9 aa, Human coronavirus
EVIYFTLIF

SEQ ID NO: 1125 - protein, 10 aa, Human coronavirus
TDYKPLSLAK

SEQ ID NO: 1126 - protein, 6 aa, Human coronavirus
SNRSQK

SEQ ID NO: 1127 - protein, 45 aa, Human coronavirus
SLRKMLLLLKIRCATSALPPKVSTWCKLLVFADQETSRETLVIFN

SEQ ID NO: 1128 - protein, 123 aa, Human coronavirus
INSALRTHVGPKLLSLLLQPVLLWVCRNLNLPIRTMMIMATLCTSFGTVEPLNLTQRIPTTISGWSFLSKILMPTKPSLRRKRNKRHQKKNQQTKCLNLQRSSVCKVASLSALAPVQVFSLVQ

SEQ ID NO: 1129 - protein, 45 aa, Human coronavirus
LMLTLISVTQSNKIAAIVCVWQPHLTIACPLLHRMESCCNYSAIR

SEQ ID NO: 1130 - protein, 6 aa, Human coronavirus
LIAMLY

SEQ ID NO: 1131 - protein, 9 aa, Human coronavirus
RLSPLLDCK

SEQ ID NO: 1132 - protein, 10 aa, Human coronavirus
TVPPGKSSTV

SEQ ID NO: 1133 - protein, 5 aa, Human coronavirus
NVNKK

SEQ ID NO: 1134 - protein, 1295 aa, human coronavirus
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISVSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGIPQTAQGVHLFSSRYVDLYGGNMFQFATLPVYDTIKYYSIIPHSIRSIQSDRKAWAAFYVYKLQPLTFLLDFSWDGYIRRAIDCGFNDLSQLHCSYESFDVESGVYSVSSFEAKPSGSVVEQAEGVECDFSVLLSGTPPQVYNFKRLVFTNCNYNLTKLLSLFSVNDFPCSQISPAAIASNCYSSLILDYFSYPLSMKSDLSVSSAGPISQFNYKQSFSNPPCLILATVPHNLPTITKPLKYSYINKCSRLLLSDDRTEVPQLVNANQYSPCPSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLPPPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFQKVQDAVNNNAQALSKLASELSNTFGAISASIGDIIQRLDVLEQDAQIDRLINGRLVTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 1135 - protein, 746 aa, human coronavirus
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISVSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGIPQTAQGVHLFSSRYVDLYGGNMFQFATLPVYDTIKYYSIIPHSIRSIQSDRKAWAAFYVYKLQPLTFLLDFSWDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAIASNCYSSLILDYFSYPLSMKSDLSVSSAGPISQFNYKQSFSNPTCLILATVPHNLPTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1136 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 1137 - protein, 767 aa, homo sapiens
MKTPWKVLLGLLGAAALVTIITVPVVLLNKGTDDATADSRKTYTLTDYLKNTYRLKLYSLPRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVNDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDRMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 1138 - protein, 1353 aa, Human coronavirus
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYYGTDTNSVCPKLEFANDTKIASQLGNCVEYSLYGVSGRGVFQNCTAVGVRQQRFVEDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLNDVNMEAAYTSSLLGSIAGVGWTAGLSSFAAIPFAQSIFYRLNGVGITQQVLSENQKLIANKFNQALGAMQTGFTTTNEAFQKVQDAVNNNAQALSKLASELSNTFGAISASIGDIIQRLDVLEQDAQIDRLINGRLTTLNAFVAQQLVRSESAALSAQLAKDKVNECVKAQSKRSGVCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPVYIWLGFIAGLVALALCVFFILCCTGCGTNCMGKLKCNRCCDRYEEYDLEPHKVHVH

SEQ ID NO: 1139 - protein, 1352 aa, Bat coronavirus HKU5
MIRSVLVLMCSLTFIGNLTRGQSVDMGHNGTGSCLDSQVQPDYFESVHTTWPMPIDTSKAEGVIYPNGKSYSNITLTYTGLYPKANDLGKQYLFSDGHSAPGRLNNLFVSNYSSQVESFDDGFVVRIGAAANKTGTTVISQSTFKPIKKIYPAFLLGHSVGNYTPSNRTGRYLNHTLVILPDGCGTILHAFYCVLHPRTQQNCAGETNFKSLSLWDTPASDCVSGSYNQEATLGAFKVYFDLINCTFRYNYTITEDENAEWFGITQDTQGVHLYSSRKENVFRNNMFHFATLPVYQKILYYTVIPRSIRSPFNDRKAWAAFYIYKLHPLTYLLNFDVEGYITKAVDCGYDDLAQLQCSYESFEVETGVYSVSSFEASPRGEFIEQATTQECDFTPMLTGTPPPIYNFKRLVFTNCNYNLTKLLSLFQVSEFSCHQVSPSSLATGCYSSLTVDYFAYSTDMSSYLQPGSAGAIVQFNYKQDFSNPTCRVLATVPQNLTTITKPSNYAYLTECYKTSAYGKNYLYNAPGAYTPCLSLASRGFSTKYQSHSDGELTTTGYIYPVTGNLQMAFIISVQYGTDTNSVCPMQALRNDTSIEDKLDVCVEYSLHGITGRGVFHNCTSVGLRNQRFVYDTFDNLVGYHSDNGNYYCVRPCVSVPVSVIYDKASNSHATLFGSVACSHVTTMMSQFSRMTKTNLLARTTPGPLQTTVGCAMGFINSSMVVDECQLPLGQSLCAIPPTTSSRVRRATSGASDVFQIATLNFTSPLTLAPINSTGFVVAVPTNFTFGVTQEFIETTIQKITVDCKQYVCNGFKKCEDLLKEYGQFCSKINQALHGANLRQDESIANLFSSIKTQNTQPLQAGLNGDFNLTMLQIPQVTTGERKYRSTIEDLLFNKVTIADPGYMQGYDECMQQGPQSARDLICAQYVAGYKVLPPLYDPYMEAAYTSSLLGSIAGASWTAGLSSFAAIPFAQSIFYRLNGVGITQQVLSENQKIIANKFNQALGAMQTGFTTTNLAFNKVQDAVNANAMALSKLAAELSNTFGAISSSISDILARLDTVEQEAQIDRLINGRLTSLNAFVAQQLVRTEAAARSAQLAQDKVNECVKSQSKRNGFCGTGTHIVSFAINAPNGLYFFHVGYQPTSHVNATAAYGLCNTENPQKCIAPIDGYFVLNQTTSTVADSDQQWYYTGSSFFHPEPITEANSKYVSMDVKFENLTNRLPPPLLSNSTDLDFKEELEEFFKNVSSQGPNFQEISKINTTLLNLNTELMVLSEVVKQLNESYIDLKELGNYTFYQKWPWYIWLGFIAGLVALALCVFFILCCTGCGTSCLGKLKCNRCCDSYDEYEVEKIHVH

SEQ ID NO: 1140 - protein, 1352 aa, Bat coronavirus HKU4
MTLLMCLLMSLLIFVRGCDSQFVDMSPASNTSECLESQVDAAAFSKLMWPYPIDPSKVDGIIYPLGRTYSNITLAYTGLFPLQGDLGSQYLYSVSHAVGHDGDPTKAYISNYSLLVNDFDNGFVVRIGAAANSTGTIVISPSVNTKIKKAYPAFILGSSLTNTSAGQPLYANYSLTIIPDGCGTVLHAFYCILKPRTVNRCPSGTGYVSYFIYETVHNDCQSTINRNASLNSFKSFFDLVNCTFFNSWDITADETKEWFGITQDTQGVHLYSSRKGDLYGGNMFRFATLPVYEGIKYYTVIPRSFRSKANKREAWAAFYVYKLHQLTYLLDFSVDGYIRRAIDCGHDDLSQLHCSYTSFEVDTGVYSVSSYEASATGTFIEQPNATECDFSPMLTGVAPQVYNFKRLVFSNCNYNLTKLLSLFAVDEFSCNGISPDSIARGCYSTLTVDYFAYPLSMKSYIRPGSAGNIPLYNYKQSFANPTCRVMASVLANVTITKPHAYGYISKCSRLTGANQDVETPLYINPGEYSICRDFSPGGFSEDGQVFKRTLTQFEGGGLLIGVGTRVPMTDNLQMSFIISVQYGTGTDSVCPMLDLGDSLTITNRLGKCVDYSLYGVTGRGVFQNCTAVGVKQQRFVYDSFDNLVGYYSDDGNYYCVRPCVSVPVSVIYDKSTNLHATLFGSVACEHVTTMMSQFSRLTQSNLRRRDSNIPLQTAVGCVIGLSNNSLVVSDCKLPLGQSLCAVPPVSTFRSYSASQFQLAVLNYTSPIVVTPINSSGFTAAIPTNFSFSVTQEYIETSIQKVTVDCKQYVCNGFTRCEKLLVEYGQFCSKINQALHGANLRQDESVYSLYSNIKTTSTQTLEYGLNGDFNLTLLQVPQIGGSSSSYRSAIEDLLFDKVTIADPGYMQGYDDCMKQGPQSARDLICAQYVSGYKVLPPLYDPNMEAAYTSSLLGSIAGAGWTAGLSSFAAIPFAQSMFYRLNGVGITQQVLSENQKLIANKFNQALGAMQTGFTTSNLAFSKVQDAVNANAQALSKLASELSNTFGAISSSISDILARLDTVEQDAQIDRLINGRLISLNAFVSQQLVRSETAARSAQLASDKVNECVKSQSKRNGFCGSGTHIVSFVVNAPNGFYFFHVGYVPTNYTNVTAAYGLCNNNNPPLCIAPIDGYFITNQTTTYSVDTEWYYTGSSFYKPEPITQANSRYVSSDVKFDKLENNLPPPLLENSTDVDFKDELEEFFKNVTSHGPNFAEISKINTTLLDLSDEMAMLQEVVKQLNDSYIDLKELGNYTYYNKWPWYVWLGFIAGLVALLLCVFFLLCCTGCGTSCLGKMKCKNCCDSYEEYDVEKIHVH

SEQ ID NO: 1141 - protein, 231 aa, Human coronavirus
SGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKL

SEQ ID NO: 1142 - protein, 221 aa, Bat coronavirus HKU5
TGVYSVSSFEASPRGEFIEQATTQECDFTPMLTGTPPPIYNFKRLVFTNCNYNLTKLLSLFQVSEFSCHQVSPSSLATGCYSSLTVDYFAYSTDMSSYLQPGSAGAIVQFNYKQDFSNPTCRVLATVPQNLTTITKPSNYAYLTECYKTSAYGKNYLYNAPGAYTPCLSLASRGFSTKYQSHSDGELTTTGYIYPVTGNLQMAFIISVQYGTDTNSVCPMQ

SEQ ID NO: 1143 - protein, 231 aa, Bat coronavirus HKU4
TGVYSVSSYEASATGTFIEQPNATECDFSPMLTGVAPQVYNFKRLVFSNCNYNLTKLLSLFAVDEFSCNGISPDSIARGCYSTLTVDYFAYPLSMKSYIRPGSAGNIPLYNYKQSFANPTCRVMASVLANVTITKPHAYGYISKCSRLTGANQDVETPLYINPGEYSICRDFSPGGFSEDGQVFKRTLTQFEGGGLLIGVGTRVPMTDNLQMSFIISVQYGTGTDSVCPML

The invention claimed is:

1. A diagnostic kit for diagnosing a MERS-CoV infection comprising:
    a nucleic acid molecule at least 95% identical to the sequence of SEQ ID NO: 14, 15, 489, or 653 or a fragment thereof which can be used as a probe or primer capable of specifically hybridizing to the sequence of SEQ ID NO: 14, 15, 489, or 653 that specifically detects MERS-CoV, or
    a proteinaceous molecule encoded by the nucleic acid molecule or the fragment thereof, wherein the nucleic acid molecule or the fragment thereof is detectably labelled, the detectable label selected from the group consisting of a radioisotope, a fluorophore, a quencher of fluorescence, an enzyme, an affinity tag, and combinations thereof, and
    Instructions for detecting the MERS-CoV.

2. A proteinaceous substance comprising a proteinaceous molecule encoded by a nucleic acid molecule at least 95% identical to the sequence of SEQ ID NO: 14, 15, 489, or 653, and additionally comprising at least a fragment of an N-terminal dipeptidyl peptidase protein.

3. A substance according to claim 2 wherein said proteinaceous molecule comprises an ectodomain of a spike protein.

4. A substance according to claim 2 wherein said peptidase protein is a dipeptidyl peptidase 4 (DPP4).

5. A substance according to claim 2 having been subjected to crystallization.

6. A method for detecting a MERS-CoV infection, the method comprising using a method selected from southern blot or PCR with the kit of claim 1.

* * * * *